US007605228B2

(12) United States Patent
Hey et al.

(10) Patent No.: US 7,605,228 B2
(45) Date of Patent: *Oct. 20, 2009

(54) INSECTICIDAL TOXIN COMPLEX FUSION PROTEINS

(75) Inventors: Timothy Denver Hey, Zionsville, IN (US); Thomas Meade, Zionsville, IN (US); Stephanie Love Burton, Indianapolis, IN (US); Donald Joseph Merlo, Carmel, IN (US); Qihua Cai, Westfield, IN (US); Haley Jo Moon, Fishers, IN (US); Joel Jay Sheets, Zionsville, IN (US); Aaron Todd Woosley, Fishers, IN (US)

(73) Assignee: Dow AgroSciences LLC, Indianapolis, IN (US)

( * ) Notice: Subject to any disclaimer, the term of this patent is extended or adjusted under 35 U.S.C. 154(b) by 299 days.

This patent is subject to a terminal disclaimer.

(21) Appl. No.: 11/070,573

(22) Filed: Mar. 2, 2005

(65) Prior Publication Data

US 2006/0168683 A1 Jul. 27, 2006

Related U.S. Application Data

(60) Provisional application No. 60/549,516, filed on Mar. 2, 2004, provisional application No. 60/549,502, filed on Mar. 2, 2004.

(51) Int. Cl.

| | |
|---|---|
| *C07K 14/00* | (2006.01) |
| *C07K 17/00* | (2006.01) |
| *A61K 38/43* | (2006.01) |
| *A01N 25/00* | (2006.01) |

(52) U.S. Cl. ....................... 530/350; 424/94.1; 424/405

(58) Field of Classification Search ....................... None
See application file for complete search history.

(56) References Cited

U.S. PATENT DOCUMENTS

| | | | |
|---|---|---|---|
| 6,281,413 | B1 | 8/2001 | Kramer et al. |
| 6,528,484 | B1 | 3/2003 | Ensign et al. |
| 2002/0078478 | A1 * | 6/2002 | Ffrench-Constant et al. |
| 2004/0103455 | A1 | 5/2004 | Ffrench-Constant et al. |
| 2004/0194164 | A1 | 9/2004 | Bintrim et al. |
| 2004/0208907 | A1 | 10/2004 | Hey et al. |
| 2007/0020625 | A1 | 1/2007 | Duchaud et al. |

FOREIGN PATENT DOCUMENTS

| | | | |
|---|---|---|---|
| WO | WO 99/03328 | A1 | 1/1999 |
| WO | WO 02/094867 | | 11/2002 |
| WO | WO 2004/002223 | | 1/2004 |
| WO | WO 2004/044217 | | 5/2004 |
| WO | WO 2004/067727 | A3 | 8/2004 |
| WO | WO 2004/067750 | A3 | 8/2004 |

OTHER PUBLICATIONS

Kisselev, Structure, vol. 10, pp. 8-9, 2002.*
Witkowski et al., Biochemistry, 38, 11643-11650, 1999.*
Wishart et al., Journal of Biological Chemistry, vol. 270, No. 45, pp. 26782-26785, 1995.*
Bulow et al., Trends Biotech., 9: 226-231, 1991.*
Argos, J. Mol. Biol., 211: 943-958, 1990.*
Waterfield, N. et al. "Oral Toxicity of *Photorhabdus luminescens* W14 Toxin Complexes in *Escherichia coli" Applied and Environmental Microbiology*, Nov. 2001, XP-002256036, pp. 5017-5024, vol. 67. No. 11.
Ffrench-Constant, R. et al. "Photorhabdus toxins: novel biological insecticides" *Current Opinion in Microbiology, Current Biology Ltd*, GB, Jun. 3, 1999, XP-002282362, pp. 284-288, vol. 2, No. 3.
Birren, B., et al., "*Fusarium graminearum* genome sequence," NCBI Accession No. EAA68452, Feb. 13, 2004.

* cited by examiner

*Primary Examiner*—Suzanne M. Noakes
*Assistant Examiner*—Jae W Lee
(74) *Attorney, Agent, or Firm*—Jay Sanders; Donald Stuart

(57) ABSTRACT

The subject invention relates to insecticidal toxin complex ("TC") fusion proteins and to polynucleotides that encode these fusion proteins. In some embodiments, the invention provide a fusion protein comprising a Class A protein, a Class B protein, and a Class C TC protein fused together to form a single protein. In some other embodiments, the invention provides a fusion protein compromising a Class B and a Class C TC proteins fused together. In the latter embodiments, the BC and CB fusion protein can be used to enhance or potentate the anti-insect activity of a "Toxin A" or Class A protein. The subject invention also includes plants, cells (bacterial and plant cells for example) and seeds that comprise the polynucleotides. The subject invention also includes methods of controlling pests (preferably insects and other plant pests) with fusion proteins of the subject invention.

20 Claims, 1 Drawing Sheet

INSECTICIDAL TOXIN COMPLEX FUSION PROTEINS

CROSS-REFERENCE TO RELATED APPLICATIONS

This application claims the benefit of provisional application Ser. No. 60/549,516, filed Mar. 2, 2004, and of provisional application Ser. No. 60/549,502, filed Mar. 2, 2004.

INCORPORATION BY REFERENCE

The Sequence Listing for this application is on duplicate compact discs labeled "Copy 1" and "Copy 2." Copy 1 and Copy 2 each contain only one file named "DAS-118XC1rev.ST25.txt" which was created on Feb. 5, 2007, and is 805 KB. The entire contents of each of the compact discs are incorporated herein by reference in their entireties.

BACKGROUND

Billions of dollars are spent each year to control insect pests and additional billions are lost to the damage they inflict. Synthetic organic chemical insecticides have been the primary tools used to control insect pests but biological insecticides, such as the insecticidal proteins derived from *Bacillus thuringiensis* (B.t.), have played an important role in some areas. The ability to produce insect resistant plants through transformation with B.t. insecticidal protein genes has revolutionized modern agriculture and heightened the importance and value of insecticidal proteins and their genes.

Two different B.t. genes to be "stacked" so that a plant produces two different types of B.t. proteins. This has been done to increase the plant's spectrum of insect resistance and to prevent the development of insects that are resistant to a single type of B.t. protein. Compared to expressing a single gene, expressing multiple genes is relatively more involved. It is common in the generation of transgenic eukaryotes, including transgenic plants, that the coding regions for individual proteins are assembled and introduced as individual genes, with each having a separate set of promoter and transcriptional termination regions.

Toxin Complex (TC) proteins and genes, found primarily in bacteria of the genera *Photorhabdus* and *Xenorhabdus* but also in other bacterial genera such as *Serratia, Pseudomonas*, and *Paenibacillus*, are an important, relatively new source of insecticidal proteins and genes. There are at least three distinct classes of TC proteins. Native Class A TC proteins are approximately 280 kDa in size and possess insecticidal activity. Class B TC proteins (approximately 170 kDa) and Class C TC proteins (approximately 112 kDa) in combination enhance the insecticidal potency of Class A TC proteins but possess little to no insecticidal activity in the absence of a Class A TC protein. That is to say, Class B and Class C TC proteins in combination potentiate the insecticidal activity of Class A TC proteins. See e.g. US-2004-0208907 and WO 2004/067727 for a more detailed review of the art. Class A TC proteins possess insecticidal activity, alone, but this activity is relatively low. When a Class A TC protein is combined with a Class B and a Class C TC protein, they form a complex that is much more potent than the Class A TC protein alone.

The exact mechanism(s) of insecticidal action for TC proteins is not understood. It is possible that the proteins interact and/or assemble with each other during the course of killing the insect.

BRIEF SUMMARY

The subject invention relates to insecticidal toxin complex ("TC") fusion proteins and to polynucleotides that encode these fusion proteins. In some embodiments, the invention provides a fusion protein comprising a Class A protein, a Class B protein, and a Class C TC protein fused (in any order) together to form a single protein. In some other embodiments, the invention provides a fusion protein comprising a Class B TC protein and a Class C TC protein fused together. In the latter embodiments, the BC or CB fusion protein can be used to enhance or potentiate the anti-insect activity of a "Toxin A" or Class A protein.

The subject invention relates in part to the surprising discovery that fusion proteins of the subject invention have the same level of activity, as compared to the non-fused proteins. In some cases, the subject fusion proteins can have even better activity than the individual (non-fused) components. Even the finding that the activity was retained at the same levels as the non-fused proteins was surprising. Heretofore, there was no expectation that fused TC proteins would properly function and retain their activity (when fused together). This is due in part to lack of knowledge regarding whether these proteins could properly interact with each other when in a fused state. There was also no prior motivation to make such constructs and proteins.

The subject invention includes the subject fusion proteins, polynucleotides that encode the fusion proteins, and vectors comprising said polynucleotides. The subject invention also includes plants, cells (bacterial and plant cells for example), and seeds that comprise said polynucleotides. Said plants can produce fusion proteins of the subject invention, which convey insect resistance to said plants. The invention includes transgenic plants that express Class A, Class B, and Class C TC proteins as a single fusion protein. The invention also includes transgenic plants that express Class B and Class C TC proteins as a single fusion protein. The present invention provides a method of protecting a plant from an insect by expressing in the plant effective amounts of a fusion protein of the subject invention.

The subject invention includes methods of inhibiting/controlling pests (preferably insects and other plant pests) with fusion proteins of the subject invention. Methods of the subject invention include a method of protecting a plant from damage by insects wherein said method comprises expressing, in the plant, an effective amount of at least one type of fusion protein of the subject invention, wherein the fusion protein is produced as a single fusion protein. Thus, the present invention includes an improvement in a method of protecting a plant from insect damage wherein said method comprises expressing, in the plant, an effective amount of Toxin Complex (TC) Class A, Class B and Class C TC proteins, wherein the improvement comprises expressing at least two of said proteins as a single fusion protein. Methods of the subject invention also include a method of protecting a plant from insect damage wherein said method comprises expressing in the plant an effective amounts of the three types of TC proteins, wherein at least two of the TC proteins are translated from a single transcript. Further methods of the subject invention also include spray-on methods and the like, which are well known in the art. In the latter cases, the improvement of the subject invention comprises providing to an insect for ingestion a fusion protein of the subject invention, wherein said protein is applied to the plant (or the vicinity of the plant).

As discussed herein, and as will be apparent to one skilled in the art having the benefit of the subject disclosure, the subject invention provides many advantages. For example, methods mentioned above offer an advantage of reducing the number of "events" needed to produce transgenic, insect-resistant plants of the subject invention. These methods also provide for temporal and spatial synchrony of translation for interacting proteins, which is particularly advantageous for eukaryotic cells.

BRIEF DESCRIPTION OF THE SEQUENCES

SEQ ID NO:1 shows the DNA sequence of the fused coding region cassette in the plasmid was designated pDAB8920. The coding regions of TcdB2, the linker peptide, and TccC3 are represented by nucleotides 48-4469, 4470-4511 and 4512-7394 of SEQ ID NO:1, respectively.

SEQ ID NO:2 shows the "8920" polypeptide encoded by the fused gene in SEQ ID NO:1. The amino acid sequences of TcdB2, the linker peptide, and TccC3 are represented by amino acids 1-1474, 1475-1488 and 1489-2448 of SEQ ID NO:2 respectively.

SEQ ID NO:3 shows the joining oligonucleotide between the tcdB2 and tccC3 coding regions.

SEQ ID NO:4 shows the polypeptide linker fragment encoded by SEQ ID NO:3.

SEQ ID NO:5 is the amino acid sequence for the Class B TC protein TcdB 1.

SEQ ID NO:6 is the amino acid sequence for the Class B TC protein TcdB2.

SEQ ID NO:7 is the amino acid sequence for the Class B TC protein TcaC.

SEQ ID NO:8 is the amino acid sequence for the Class B TC protein $XptC1_{wi}$.

SEQ ID NO:9 is the amino acid sequence for the Class B TC protein $XptB1_{xb}$.

SEQ ID NO:10 is the amino acid sequence for the Class B TC protein $PptB1_{1529}$.

SEQ ID NO:11 is the amino acid sequence for the Class B TC protein SepB.

SEQ ID NO:12 is the amino acid sequence for the Class C TC protein TccC1.

SEQ ID NO:13 is the amino acid sequence for the Class C TC protein TccC2.

SEQ ID NO:14 is the amino acid sequence for the Class C TC protein TccC3.

SEQ ID NO:15 is the amino acid sequence for the Class C TC protein TccC4.

SEQ ID NO:16 is the amino acid sequence for the Class C TC protein TccC5.

SEQ ID NO:17 is the amino acid sequence for the Class C TC protein $XptB1_{wi}$.

SEQ ID NO:18 is the amino acid sequence for the Class C TC protein $XPtC1_{xb}$.

SEQ ID NO:19 is an alternate (long) amino acid sequence for the Class C TC protein $PptC1_{1529}$ encoded by *Paenibacillus* ORF6 (long).

SEQ ID NO:20 is an alternate (short) amino acid sequence for the Class C TC protein $PptC1_{1529}$ encoded by *Paenibacillus* ORF6 (short).

SEQ ID NO:21 is the amino acid sequence for the Class C TC protein SepC.

SEQ ID NO:22 is the amino acid sequence for the Class A TC protein $XptA1_{wi}$.

SEQ ID NO:23 is the amino acid sequence for the Class A TC protein $XptA2_{wi}$.

SEQ ID NO:24 is the amino acid sequence for the Class A TC protein TcbA.

SEQ ID NO:25 is the amino acid sequence for the Class A TC protein TcdA.

SEQ ID NO:26 is the amino acid sequence for the Class A TC protein TcdA2.

SEQ ID NO:27 is the amino acid sequence for the Class A TC protein TcdA4.

SEQ ID NO:28 is the native nucleic acid sequence encoding the Class B TC protein TcdB 1.

SEQ ID NO:29 is the native nucleic acid sequence encoding the Class B TC protein TcdB2.

SEQ ID NO:30 is the native nucleic acid sequence encoding the Class B TC protein TcaC.

SEQ ID NO:31 is the native nucleic acid sequence encoding the Class B TC protein $XptC1_{wi}$.

SEQ ID NO:32 is the native nucleic acid sequence encoding the Class B TC protein $XptB1_{xb}$.

SEQ ID NO:33 is the native nucleic acid sequence encoding the Class B TC protein $PptB1_{1529}$.

SEQ ID NO:34 is the native nucleic acid sequence encoding the Class C TC protein TccC1.

SEQ ID NO:35 is the native nucleic acid sequence encoding the Class C TC protein TccC2.

SEQ ID NO:36 is the native nucleic acid sequence encoding the Class C TC protein TccC3.

SEQ ID NO:37 is the native nucleic acid sequence encoding the Class C TC protein TccC4.

SEQ ID NO:38 is the native nucleic acid sequence encoding the Class C TC protein TccC5.

SEQ ID NO:39 is the native nucleic acid sequence encoding the Class C TC protein $XptB1_{wi}$.

SEQ ID NO:40 is the native nucleic acid sequence encoding the Class C TC protein $XptC1_{xb}$.

SEQ ID NO:41 is the native nucleic acid sequence encoding the Class C TC protein $PptC1_{1529}$ ORF6 (long).

SEQ ID NO:42 is the native nucleic acid sequence encoding the Class C TC protein $PptC1_{1529}$ ORF6 (short).

SEQ ID NO:43 is a nucleic acid sequence optimized for expression in plants that encodes the Class B TC protein TcdB2.

SEQ ID NO:44 is a nucleic acid sequence optimized for expression in plants that encodes the Class C TC protein TccC3.

SEQ ID NO:45 is the nucleic acid sequence encoding TcdB2/TccC3 fusion protein 8563 (also referred to as "8563").

SEQ ID NO:46 is the amino acid sequence for TcdB2/TccC3 fusion protein 8563 (also referred to as "8563").

SEQ ID NO:47 is the nucleic acid sequence encoding TcdB2/TccC3 fusion protein 8564.

SEQ ID NO:48 is the amino acid sequence for TcdB2/TccC3 fusion protein 8564.

SEQ ID NO:49 is the nucleic acid sequence encoding TcdB2/TccC3 fusion protein 8940.

SEQ ID NO:50 is the amino acid sequence for TcdB2/TccC3 fusion protein 8940.

Figure 1:
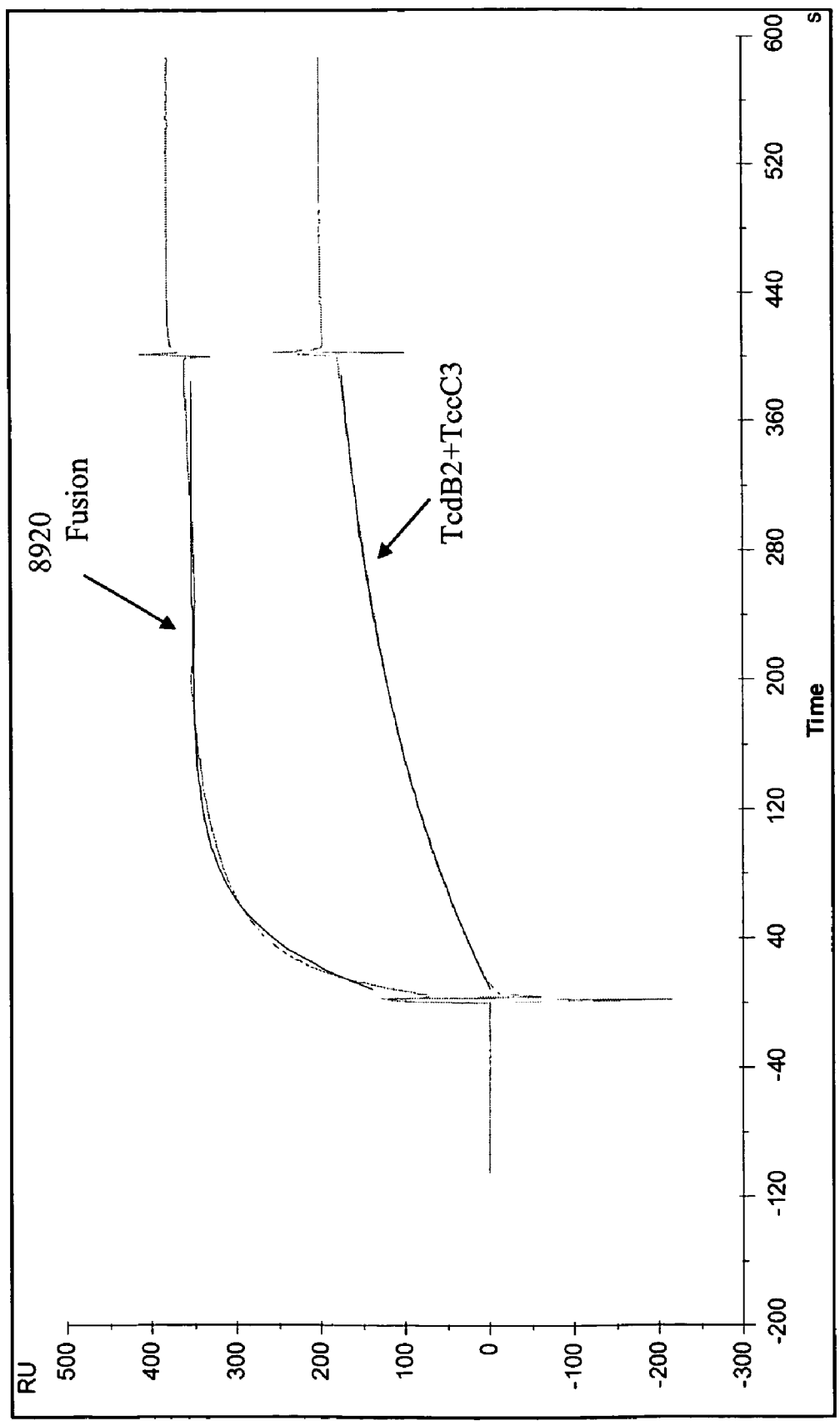
FIG. 1 shows surface plasmon resonance sensorgrams for binding of either TcdB2+TccC3 or 8920 fusion protein to immobilized XptA2.

SEQ ID NO:51 is the nucleic acid sequence encoding TcdB2/TccC3 fusion protein 8920.

SEQ ID NO:52 is the amino acid sequence for TcdB2/TccC3 fusion protein 8920.

SEQ ID NO:53 is the nucleic acid sequence encoding TcdB2/TccC3 fusion protein 8921.

SEQ ID NO:54 is the amino acid sequence for TcdB2/TccC3 fusion protein 8921.

SEQ ID NO:55 is the nucleic acid sequence encoding TcdB2/TccC3 fusion protein 8923.

SEQ ID NO:56 is the amino acid sequence for TcdB2/TccC3 fusion protein 8923.

SEQ ID NO:57 is the nucleic acid sequence encoding TcdB2/TccC3 fusion protein 8951.

SEQ ID NO:58 is the amino acid sequence for TcdB2/TccC3 fusion protein 8951.

SEQ ID NO:59 is the nucleic acid sequence encoding XptA2/TcdB2/TccC3 fusion protein 8811.

SEQ ID NO:60 is the amino acid sequence for XptA2/TcdB2/TccC3 fusion protein 8811.

SEQ ID NO:61 is the native nucleic acid sequence encoding the Class A TC protein XptA1$_{wi}$.

SEQ ID NO:62 is the native nucleic acid sequence encoding the Class A TC protein XptA2$_{wi}$.

SEQ ID NO:63 is the native nucleic acid sequence encoding the Class A TC protein TcbA.

SEQ ID NO:64 is the native nucleic acid sequence encoding the Class A TC protein TcdA.

SEQ ID NO:65 is the native nucleic acid sequence encoding the Class A TC protein TcdA2.

SEQ ID NO:66 is the native nucleic acid sequence encoding the Class A TC protein TcdA4.

SEQ ID NO:67 is the 8836 "BCA" triple fusion polynucleotide sequence.

SEQ ID NO:68 is the amino acid sequence of the 8836 "BCA" triple fusion protein encoded by SEQ ID NO:67.

SEQ ID NO:69 is the amino acid sequence of the adjacent TcdB2 protein sequence of various toxin complex fusion proteins (Table 7).

SEQ ID NO:70 is the amino acid sequence of the linker sequence of protein 8563 (Table 7).

SEQ ID NO:71 is the amino acid sequence of the adjacent TccC3 deletion of protein 8563 (Table 7).

SEQ ID NO:72 is the amino acid sequence of the adjacent TccC3 protein sequence of various toxin complex fusion proteins (Table 7).

SEQ ID NO:73 is the amino acid sequence of the linker sequence of protein 8940 (Table 7).

SEQ ID NO:74 is the amino acid sequence of the linker sequence of various toxin complex fusion proteins (Table 7).

SEQ ID NO:75 is the amino acid sequence of the first linker sequence of protein 8923 (Table 7).

SEQ ID NO:76 is the amino acid sequence of the second linker sequence of protein 8923 (Table 7).

SEQ ID NO:77 is the amino acid sequence of the adjacent TccC3 protein sequence of protein 8951 (Table 7).

SEQ ID NO:78 is the amino acid sequence of the adjacent TcdB2 protein sequence of protein 8951 (Table 7).

SEQ ID NO:79 is the amino acid sequence of the adjacent XptA2 protein sequence of protein 8811 (Table 7).

SEQ ID NO:80 is the amino acid sequence of the linker sequence of protein 8811 (Table 7).

SEQ ID NO:81 is the amino acid sequence of an adjacent TcdB2 protein sequence of protein 8811 (Table 7).

SEQ ID NO:82 is the amino acid sequence of the adjacent TccC3 protein sequence of protein 8811 (Table 7).

SEQ ID NO:83 is the amino acid sequence of a portion of the linker sequence that was derived from the *Photorhabdus* protein TcdB1 as described in Example 1.

SEQ ID NO:84 is the amino acid sequence of a portion of the linker sequence that was derived from the *Photorhabdus* protein TcdA1.

SEQ ID NO:85 is the third segment of the linker for fusion protein 8923, which is a duplication of the final 52 amino acids of TcdB2.

DETAILED DESCRIPTION OF THE INVENTION

The subject invention relates in part to the surprising discovery that Toxin Complex ("TC") proteins retain their insecticidal activity when fused (or ligated) together. Heretofore, there was no expectation that such fusion proteins would properly function and retain their activity when fused together. As referred to herein, there are Class A, Class B, and Class C toxin complex or "TC" proteins. These individual proteins can also be referred to as polypeptide components of fusion proteins of the subject invention.

Thus, the subject invention includes insecticidal TC fusion proteins and to polynucleotides that encode these fusion proteins. In some embodiments, the invention provides a fusion protein comprising a Class A, a Class B, and a Class C TC protein (or polypeptide) fused or ligated (in any order) together to form a single fusion protein. In some other embodiments, the invention provides a fusion protein comprising a Class B and a Class C TC protein fused or ligated together. In the latter embodiments, the BC or CB fusion protein can be used to enhance or potentiate the anti-insect activity of a "Toxin A" protein.

Individual Class A, Class B, and Class C TC proteins, as the term is used herein, are known in the art. Such proteins include stand-alone toxins (Class A TC proteins) and potentiators (Class B and C TC proteins). Bacteria known to produce TC proteins include those of the following genera: *Photorhabdus, Xenorhabdus, Paenibacillus, Serratia*, and *Pseudomonas*. See, e.g., *Pseudomonas syringae* pv. *Syringae* B728a (GenBank Accession Numbers gi:23470933 and gi:23472543). Any of such TC proteins can be used as polypeptide components according to the subject invention.

As discussed above in the Background section, although "Toxin A" proteins have some insecticidal activity, alone, the high insecticidal potency of the "A+B+C" complex is much preferred for commercial applications of TC proteins. However, the mechanism(s) of action of TC proteins remains unknown. Likewise, it is unknown how (and if) each of the A, B, and C components interact with each other. Thus, there was no way to predict whether fusions of the subject invention would allow for proper functioning (in the insect gut) of the three components. Thus, it came with surprise that fused TC proteins are highly effective for controlling insects. There was no expectation that the subject fusions would be active (i.e., toxic) after ingestion by the target insect. It is shown herein that fusion proteins of the subject invention surprisingly function quite well in the insect gut.

Having shown that A-, B-, and C-type TC polypeptides, when produced as a fusion protein of the subject invention are still able to physically interact to form an active ABC complex, the subject fusion genes (that encode the subject TC fusion proteins) may be used to address technical challenges of coordinate expression of at least three genes. It was not previously suggested to fuse any of the A, B, or C components together in an attempt to address these challenges. The subject disclosure shows that it is now possible to address and alleviate technical challenges of coordinate expression of at least three genes by practicing the subject invention. These technical challenges are more significant in eukaryotes, such as plants. In prokaryotic cells it is common that the coding regions for proteins that interact with one another are arranged in sequential order and are transcribed into a single mRNA. Sequential translation of these coding regions results in synthesis of the respective proteins in close temporal and physical proximity to one another, thus ensuring that the partner proteins are available for efficient assembly into the complex. Eukaryotic cells are larger and structurally more complex than prokaryotic cells. The genome of eukaryotic cells is contained in the nucleus and mRNA must be transported outside of the nucleus to the cytoplasm where protein synthesis occurs. In eukaryotic cells, interacting proteins are usually encoded by separate genes and coding regions, and this can lead to non co-ordinate biosynthesis of both the mRNAs and the encoded proteins. Assembly of the partner proteins is thus affected by temporal and spatial disjunction; the separate proteins must find each other through a milieu of other proteins and escape degradation by intracellular proteases.

While each of introduced genes may be necessary for providing the desired phenotype in the resulting transgenic organism (e.g., in a transgenic plant one gene may confer insect resistance and another herbicide tolerance), it is not common to require an interaction among the transgenically expressed proteins to produce the desired phenotype. Such interactions can be difficult to engineer. For example, the introduction of multiple genes through transformation can result in undesirable outcomes due to non-linked integration sites, construct rearrangements or deletions, and non-compatible expression patterns of the individual genes.

Thus, the subject invention is an unexpected solution to expressing three interacting proteins in plants. It was not heretofore suggested that fused TC proteins be used as a solution to three-gene-plant-expression issues.

As will be apparent to one skilled in the art having the benefit of the subject disclosure, the subject invention provides many advantages. First, various fusions of the subject invention worked as well or even better than the individual counterparts at killing or otherwise inhibiting insects. Having shown that fusion proteins of the subject invention will effectively kill or inhibit target insects, there are many advantages associated with the subject novel approach of using fused TC genes. Some additional advantages of the subject invention are as follows.

The subject invention allows for a reduction in the number of independently expressed genes required to produce an insect resistant transgenic plant (from three TC genes to one or two fusion genes, in preferred embodiments). The corresponding reduction in size of the plant transformation construction may increase transformation frequency and overall recovery of transgenics. The stability of transgenic plants may be increased, as only one or two independent genes are required. The probability of recovering active transgenic plants may be increased due to an increase in the efficiency of active complex formation in plants.

The subject invention includes vectors comprising polynucleotides of the subject invention. The subject invention also includes plants, cells (bacterial and plant cells for example), and seeds that comprise said polynucleotides. Said plants can produce fusion proteins of the subject invention, which conveys insect resistance to said plants. The subject invention also includes methods of controlling pests (preferably insects and other plant pests) with fusion proteins of the subject invention.

Fused Gene and Protein Nomenclature. In this application the following notation is used for fused genes and fusion proteins. The linkage between fused genes present in an operon, that is, between genes that are transcriptionally linked but encode separate and distinct proteins, is indicated with a hyphen, e.g. tcdB2-tccC3. The linkage between genes that have been joined by way of a linker, thereby fusing two or more coding regions into a single open reading frame, is indicated by a slash mark, e.g. tcdB2/tccC3. The linkage in the single fusion protein encoded by such a fused gene is also designated by a slash mark, e.g. TcdB2/TccC3. The same genes or proteins fused using different linkers are distinguished by a "V" designation. For example, tcdB2/tccC3 V1 and tcdB2/tccC3 V2 represent the same genes fused using different linkers, and which encode the fusion proteins TcdB2/TccC3 V1 and TcdB2/TccC3 V2 respectively. A "+" sign can also be used to indicate non-fused components, such as when non-fused B+C potentiating activity is compared to fused B/C activity.

As used herein, the terms "linker" and "linker sequence" refer to nucleotides used to join a first protein coding region to a subsequent, immediately following protein coding region, such that both the first and second (and/or subsequent) protein coding regions form a single longer protein coding region in the +1 reading frame, as defined by the open reading frame of the first protein coding region. Such linker or linker sequence therefore cannot include translation termination codons in the +1 reading frame. As a consequence of translation of the linker or linker sequence, the protein encoded by the first protein coding region is joined by one or more amino acids to the protein encoded by the second protein coding region. A linker is optional, as the polypeptide components can be ligated directly, without a linker sequence.

As used herein, reference to "isolated" polynucleotides and/or proteins, and "purified" proteins refers to these molecules when they are not associated with the other molecules with which they would be found in nature. Thus, reference to "isolated" and/or "purified" signifies the involvement of the "hand of man" as described herein. For example, a bacterial protein "gene" of the subject invention put into a plant for expression is an "isolated polynucleotide." Likewise, a fusion protein, exemplified herein, produced by a plant is an "isolated protein." The term "ligated" can also be used to signify involvement of the "hand of man." That is, one polypeptide component can be synthetically joined or "ligated" to another polypeptide component to form a fusion protein of the subject invention.

A "recombinant" molecule refers to a molecule that has been recombined. When made in reference to a nucleic acid molecule, the term refers to a molecule that is comprised of nucleic acid sequences that are joined together by means of molecular biological techniques. The term "recombinant" when made in reference to a protein or a polypeptide refers to a protein molecule that is produced using one or more recombinant nucleic acid molecules.

The term "heterologous" when made in reference to a nucleic acid sequence refers to a nucleotide sequence that is ligated to, or is manipulated to become ligated to, a nucleic acid sequence to which it is not joined in nature, or to which it is joined at a different location in nature. The term "heterologous" therefore indicates that the nucleic acid molecule has been manipulated using genetic engineering, i.e. by human intervention. Thus, a fusion protein gene of the subject invention can be operably linked to a heterologous promoter (or a "transcriptional regulatory region" which means a nucleotide sequence capable of mediating or modulating transcription of a nucleotide sequence of interest, when the transcriptional regulatory region is operably linked to the sequence of interest). Preferred heterologous promoters can be plant promoters. A promoter and/or a transcriptional regulatory region and a sequence of interest (a fusion gene) are "operably linked" when the sequences are functionally connected so as to permit transcription of the sequence of interest to be mediated or modulated by the transcriptional regulatory region. In some embodiments, to be operably linked, a transcriptional regulatory region may be located on the same strand as the sequence of interest. The transcriptional regulatory region may in some embodiments be located 5' of the sequence of interest. In such embodiments, the transcriptional regulatory region may be directly 5' of the sequence of interest or there may be intervening sequences between these regions. The operable linkage of the transcriptional regulatory region and the sequence of interest may require appropriate molecules (such as transgenic activator proteins) to be bound to the transcriptional regulatory region, the invention therefore encompasses embodiments in which such molecules are provided, either in vitro or in vivo.

Fusion Proteins and Constructs of the Subject Invention. In some embodiments, this invention relates to the fusion of a TC gene encoding a Class B TC protein to a TC gene encoding a Class C TC protein so that the fused gene produces a fused protein. The fusion can be direct, or a linker sequence may connect the two coding regions. The invention encompasses both BC fusions and CB fusions, i.e. the coding sequences can be fused in either order.

This invention also includes the fusion of a TC gene encoding a Class A TC protein, a gene encoding a Class B TC protein, and a TC gene encoding a Class C TC protein so that the fused gene produces a fused protein. The fusion can be direct, or a linker sequence may connect the two coding regions. The three components can be fused in any order, e.g. ABC, ACB, BAC, BCA, CAB, or CBA.

Thus, the subject invention includes Class A/Class B/Class C TC fusion proteins, polynucleotides that encode Class A/Class B/Class C TC fusion proteins, vectors comprising said polynucleotides, and plants, cells (bacterial and plant cells for example), and seeds that comprise said polynucleotides. Said plants can produce fusion proteins of the subject invention, which convey insect resistance to said plants. These embodiments reduce by two thirds the number of transcriptional control sequences required for expression in plants and other organisms and eliminates the disadvantages that accompany transformation of separate, complete genes. These embodiments also provide a mechanism for maintaining physical and temporal synchrony of translation for interacting proteins, particularly in eukaryotic cells.

The subject invention also includes Class B/Class C TC fusion proteins, polynucleotides that encode Class B/Class C TC fusion proteins, vectors comprising said polynucleotides, and plants, cells (bacterial and plant cells for example), and seeds that comprise said polynucleotides. Said plants can produce fusion proteins of the subject invention, which, when combined with Class A TC proteins, convey insect resistance to said plants. These embodiments reduce by at least half the number of transcriptional control sequences required for expression in plants and other organisms and eliminates the disadvantages that accompany transformation of separate, complete genes. These embodiments also provide a mechanism for maintaining physical and temporal synchrony of translation for interacting proteins, particularly in eukaryotic cells.

In some cases, the primary translation product of the fused coding regions remains largely intact and contains the activities associated with the encoded polypeptide components of the fusion protein. In other cases, the primary translation product contains a protease cleavage site(s) that is engineered into the polypeptide linker positioned between the coding sequences for the separate polypeptides. This protease cleavage site provides for the release of the polypeptide components when the primary translation product is exposed to the appropriate protease.

Restriction sites, for example, can also be engineered in the linkers, for example. In one specifically exemplified embodiment, the joining polypeptide segment between the XptA2 and TcdB2 protein domains encodes the polypeptide linker fragment shown in SEQ ID NO: 59. The linker polypeptide is nine amino acids in length and contains charged and hydrophilic amino acids flanked by proline residues. Unique recognition sites for the restriction enzymes Avr II and Spe I are contained within the corresponding, encoding oligonucleotide segment.

For some of the Examples presented below, the coding sequences for the Class B and Class C TC proteins are joined through a specially designed linker. More specifically, this Example describes a fusion of the coding regions of tcdB2 (a gene encoding a Class B TC protein) and tccC3 (a gene encoding a Class C TC protein). The fused Class B/Class C gene encodes a single polypeptide. The coding regions were joined by a short oligonucleotide segment that encodes a linker peptide. The linker peptide was engineered to allow appropriate folding of the linked Class B and Class C TC proteins and to provide accessible protease sensitive sites between the fused Class B and Class C proteins. Details of the construction of the gene used to encode the new TcdB2/TccC3 VI fusion protein are disclosed below.

In one of these Examples, lysates containing the fused TcdB2/TccC3 V1 protein are comparable in potentiating activity to lysates of cells programmed to express the non-fused potentiator genes tcdB2 and tccC3. In another of these Examples, lysates of cells programmed to express the fused coding region tcdB2/tccC3 V1 are tested in bioassay with two Class A TC proteins; TcdA (coleopteran active) and XptA2$_{wi}$ (lepidopteran active). It is shown that such lysates containing the fused TcdB2/TccC3 V1 protein are comparable in potentiating activity to lysates of cells programmed to express the non-fused potentiator genes tcdB2 and tccC3.

In a further Example, the coding sequences for Class A, Class B, and Class C TC proteins are joined through linkers. This Example describes a fusion of the coding region for the Class A TC protein XptA2 with the above-described tcdB2/tccC3 V1 fusion. Lysates containing the XptA2/TcdB2/TccC3 V1 fusion protein demonstrated excellent functional activity.

Administration of Fusion Proteins. The subject invention can be performed in many different ways. For example, a plant can be engineered to produce two types of Class A TC proteins and a Class B/Class C fusion protein. Every cell of the plant, or every cell in a given type of tissue (such as roots or leaves) can have genes to encode the two A proteins and the Class B/Class C fusion protein. Alternatively, different cells of the plant can produce only one (or more) of each of these proteins. In this situation, when an insect bites and eats tissues of the plant, it could eat a cell that produces the first Class A TC protein, another cell that produces the second Class A TC protein, and another cell that produces the Class B/Class C fusion protein. Thus, what would be important is that the plant (not necessarily each plant cell) produces two Class A TC proteins and the Class B/Class C fusion protein of the subject invention so that insect pests eat all four of these proteins when they eat tissue of the plant.

Aside from transgenic plants, there are many other ways of administering the proteins, in a combination of the subject invention, to the target pest. Spray-on applications are known in the art. Some or all of the Class A and Class B/Class C fusion proteins can be sprayed (the plant could produce one or more of the proteins and the others could be sprayed). Various types of bait granules for soil applications, for example, are also known in the art and can be used according to the subject invention.

Many combinations of various Class A, Class B, and/or Class C TC proteins can now be fused in surprising, new ways. One example set forth herein shows the use of TcdB2/TccC3 fusions to enhance the activities of XptA2 and TcdA. The use of these and other combinations will now be apparent to those skilled in the art having the benefit of the subject disclosure. See US-2004-0208907 and WO 2004/067727. Accordingly, the subject invention includes fusions of "mixed pairs" of potentiators such as a Class A gene from *Xenorhabdus*, with a Class B gene from *Photorhabdus* and a Class C gene from *Xenorhabdus*. The Class A gene can also be omitted, so the subject invention includes fusions of "mixed pairs" of potentiators such as a Class B gene from *Photorhabdus* and a Class C gene from *Xenorhabdus*. Thus, such "heterologous" combinations of "Toxin A"s and/or potentiators can be selected to maximize their ability to enhance two (for example) insecticidal proteins. That is, one might find that, for a given use, a fusion of TcdB1 (Class B) and $XptB1_{wi}$ (Class C) is a more desirable than is $XptC1_{wi}$ (Class B) and $XptB1_{wi}$ (Class C), for example. Likewise, the subject invention includes "ABC"-type fusions where the A, B, and or C are derived from different types of organisms.

The subject invention provides one skilled in the art with many surprising advantages. These advantages can be used in combination with the invention of US-2004-0208907 and WO 2004/067727, for example. Among the advantages is that one skilled in the art will now be able to use a single pair of fused potentiators to enhance the activity of a stand-alone *Xenorhabdus* protein toxin, for example, as well as a stand-alone *Photorhabdus* protein toxin, for example. (As one skilled in the art knows, *Xenorhabdus* toxin proteins tend to be more desirable for controlling lepidopterans while *Photorhabdus* toxin proteins tend to be more desirable for controlling coleopterans.) This reduces the number of genes (and transformation events) needed to be expressed by a transgenic plant to achieve effective control of a wider spectrum of target pests.

The subject invention also includes the use of a transgenic plant producing a subject TC fusion protein combination together with one or more *Bacillus thuringiensis* Cry proteins, for example. The subject fusion proteins can also be otherwise administered (by spray-on applications, for example) with other insecticidal toxins.

Toxin Complex (TC) Protein Components of the Subject TC Fusion Proteins. In light of the subject disclosure, one skilled in the art will now have a reasonable expectation that a wide variety of "A," "B," and/or "C" components can be used according to the subject invention, and that the subject invention is not limited to the embodiments specifically exemplified. For example, where particular *Photorahabdus* A, B, and/or C polypeptides are exemplified, one will know that other *Photorhabdus* TC proteins could be used or substituted. Likewise, corresponding *Xenorhabdus* TC polypeptides can be used, in place of the exemplified *Photorhabdus* polypeptides, to form fusion proteins of the subject invention. See e.g. US-2004-0208907 and WO 2004/067727.

The subject invention provides fused TC proteins. Two main embodiments are "BC" fusions and "ABC" fusions. However, it should be noted that BC-type fusions include C-to-B fusions, and that "ABC" fusions are not limited to A-to-B-to-C fusions. Various other possible arrangements and orientations are discussed in more detail below.

"BC" (or "CB") fusion proteins of the subject invention are typically in the molecular weight range of approximately 220 kDa to approximately 295 kDa, depending on the exact "B" and "C" components (and linkers if any) that are selected for use according to the subject invention. A preferred weight, for example, is in the approximate range of 280-285 kDa. The individual B and C components of the subject BC fusion protein (which potentiate a Class A toxin) can be defined in several ways, as discussed in more detail below.

"ABC" fusion proteins of the subject invention (including ACB fusions, for example) are typically in the molecular weight range of approximately 450 kDa to approximately 590 kDa, depending on the exact A, B, and C components (and linkers if any) that are selected for use according to the subject invention. A preferred weight, for example, is in the approximate range of 560-565 kDa. The individual A, B, and C components can be defined in several ways, as discussed in more detail below.

As used herein, a "Class A TC protein" is a 230-290 kDa TC protein that has stand alone insecticidal activity, and has an amino acid sequence at least 40% identical to a sequence selected from $XptA1_{wi}$ (SEQ ID NO:22), $XptA2_{wi}$ (SEQ ID NO:23), TcbA (SEQ ID NO:24), TcdA (SEQ ID NO:25), TcdA2 (SEQ ID NO:26), and TcdA4 (SEQ ID NO:27).

Unless otherwise specified, as used herein, percent sequence identity and/or similarity of two nucleic acids is determined using the algorithm of Karlin and Altschul (1990), *Proc. Natl. Acad. Sci. USA* 87:2264-2268, modified as in Karlin and Altschul (1993), *Proc. Natl. Acad. Sci. USA* 90:5873-5877. Such an algorithm is incorporated into the NBLAST and XBLAST programs of Altschul et al. (1990), *J. Mol. Biol.* 215:402-410. BLAST nucleotide searches are performed with the NBLAST program, score=100, wordlength=12. Gapped BLAST can be used as described in Altschul et al. (1997), *Nucl. Acids Res.* 25:3389-3402. When utilizing BLAST and Gapped BLAST programs, the default parameters of the respective programs (NBLAST and XBLAST) are used. See NCBI/NIH website. The scores can also be calculated using the methods and algorithms of Crickmore et al. as described in the Background section, above.

To obtain gapped alignments for comparison purposes, the AlignX function of Vector NTI Suite 8 (InforMax, Inc., North Bethesda, Md., U.S.A.), was used employing the default parameters. These were: a Gap opening penalty of 15, a Gap extension penalty of 6.66, and a Gap separation penalty range of 8. Two or more sequences can be aligned and compared in this manner or using other techniques that are well-known in the art. By analyzing such alignments, relatively conserved and non-conserved areas of the subject polypeptides can be identified. This can be useful for, for example, assessing whether changing a polypeptide sequence by modifying or substituting one or more amino acid residues can be expected to be tolerated.

Examples of Class A TC proteins are set forth herein in SEQ ID NOs:22-25. The examples include TcbA and TcdA from *Photorhabdus*, XptA1 and XptA2 from *Xenorhabdus*, and SepA from *Serratia entomophila* (GenBank Accession No. AAG09642.1). Class A TC proteins can be ~230 kDa (especially if truncated), ~250-290 kDa, ~260-285 kDa, and ~270 kDa, for example. It was known that the Class A TC protein TcdA is active, alone, against *Manduca sexta*.

Sequence identity comparisons for known Class A TC proteins are provided in Table 1. These comparisons demonstrate that 40% sequence identity is an appropriate criterion for defining Class A TC proteins.

TABLE 1

Sequence identity comparisons for Class A TC proteins

| | TcdA % Identity | TcdA2 % Identity | TcdA4 % Identity | TcbA % Identity | XptA1$_{wi}$ % Identity | XptA2$_{wi}$ % Identity | SepA % Identity |
|---|---|---|---|---|---|---|---|
| *Photorhabdus luminescens* A Class | | | | | | | |
| TcdA | 100.0 | 55.0 | 68.0 | 50.1 | 46.3 | 40.6 | 40.7 |
| TcdA2 | | 100.0 | 55.9 | 42.4 | 41.3 | 36.8 | 34.7 |
| TcdA4 | | | 100.0 | 49.4 | 44.4 | 38.7 | 38.7 |
| TcbA | | | | 100.0 | 43.7 | 40.8 | 40.2 |
| *Xenorhabdus nematophilus* xwi A Class | | | | | | | |
| XptA1$_{wi}$ | | | | | 100.0 | 44.2 | 46.6 |
| XptA2$_{wi}$ | | | | | | 100.0 | 38.2 |
| *Serratia entomophila* A Class | | | | | | | |
| SepA | | | | | | | 100.0 |

Some Class A TC proteins can be defined and/or characterized by a polynucleotide that encodes the protein is encoded by a polynucleotide. Such polynucleotides can be identified by their ability to hybridize (under stringent conditions) with a nucleic acid selected from SEQ ID NOs:61-66. Stated another way, a Class A polypeptide component of the subject invention can be encoded by a polynucleotide that hybridizes with the complement of a polynucleotide that codes for a polypeptide selected from SEQ ID NOs:22-27. It should be noted that DNA sequences can be optimized, for example, for expression in plants, and that some degree of variation is within the subject invention.

Examples of Class A TC proteins are set forth herein in SEQ ID NOs:22-27. The examples include TcbA and TcdA from *Photorhabdus*, XptA1 and XptA2 from *Xenorhabdus*, and SepA from *Serratia entomophila* (GenBank Accession No. AAG09642.1). Class A TC proteins can be ~230 kDa (especially if truncated), ~250-290 kDa, ~260-285 kDa, and ~270 kDa, for example. It was known that the Class A TC protein TcdA is active, alone, against *Manduca sexta*.

In addition to those specifically identified in SEQ ID NOs: 22-27, Class A TC proteins include, for example:
 1) proteins obtained from wild type organisms;
 2) variants arising from mutations;
 3) variants designed by making conservative amino acid substitutions; and
 4) variants produced by random fragmentation and reassembly of a plurality of different sequences that encode Class A TC proteins (DNA shuffling).

See e.g. U.S. Pat. No. 5,605,793.

The DNA sequences encoding the Class A TC proteins can be wild type sequences, mutant sequences, or synthetic sequences designed to express a predetermined Class A TC protein. DNA sequences designed to be highly expressed in plants by, for example, avoiding polyadenylation signals, and using plant-preferred codons, are particularly useful. Examples of plant optimized nucleic acids encoding Class A TC proteins are disclosed, for example, in U.S. Pat. No. 6,590,142.

As used herein, a "Class B TC protein" is a 130-180 kDa protein having an amino acid sequence with at least 40% identity to a sequence selected from the group consisting of:
 TcdB1 (SEQ ID NO:5),
 TcdB2 (SEQ ID NO:6),
 TcaC (SEQ ID NO:7),
 XptC1$_{wi}$ (SEQ ID NO:8),
 XptB1$_{xb}$ (SEQ ID NO:9),
 PptB1$_{1529}$ (SEQ ID NO:10), and
 Sep B (SEQ ID NO:11), said protein being capable of increasing the toxicity of a Class A TC protein when used in combination with a Class C TC protein (as defined below).

Sequence identity comparisons for known Class B TC proteins are provided in Table 2. These comparisons demonstrate that 40% sequence identity is an appropriate criterion for defining Class B TC proteins.

TABLE 2

Sequence identity comparisons for known Class B TC proteins.

| | TcdB1 % Identity | TcdB2 % Identity | TcaC % Identity | XptC1$_{wi}$ % Identity | XptB1$_{xb}$ % Identity | PptB1 (Orf5) % Identity | SepB % Identity |
|---|---|---|---|---|---|---|---|
| *Photorhabdus luminescens* B Class | | | | | | | |
| TcdB1 | 100.0 | 75.6 | 58.2 | 50.2 | 54.6 | 42.3 | 52.6 |
| TcdB2 | | 100.0 | 57.2 | 49.8 | 53.3 | 42.0 | 51.4 |
| TcaC | | | 100.0 | 51.6 | 59.8 | 42.6 | 50.1 |
| *Xenorhabdus nematophilus* xwi B Class | | | | | | | |
| XptC1$_{wi}$ | | | | 100.0 | 53.2 | 40.7 | 47.8 |

TABLE 2-continued

Sequence identity comparisons for known Class B TC proteins.

| | TcdB1 % Identity | TcdB2 % Identity | TcaC % Identity | XptC1$_{wi}$ % Identity | XptB1$_{xb}$ % Identity | PptB1 (Orf5) % Identity | SepB % Identity |
|---|---|---|---|---|---|---|---|
| *Xenorhabdus bovienii* B Class | | | | | | | |
| XptB1$_{xb}$ | | | | | 100.0 | 40.6 | 46.0 |
| *Paenibacillus* spp str 1529 B Class | | | | | | | |
| PptB1 (Orf5) | | | | | | 100.0 | 38.7 |
| *Serratia entomophila* B Class | | | | | | | |
| SepB | | | | | | | 100.0 |

Class B TC proteins of the subject invention can be encoded by a polynucleotide having a complement that hybridizes under stringent conditions with a nucleic acid of one of SEQ ID NOs:28-33. Stated another way, a Class B polypeptide component of the subject invention can be encoded by a polynucleotide that hybridizes with the complement of a polynucleotide that codes for a polypeptide selected from SEQ ID NOs:5-11. It should be noted that DNA sequences can be optimized, for example, for expression in plants, and that some degree of variation is within the subject invention.

Examples of the Class B TC proteins are set forth herein in SEQ ID NOs:5-11. The examples include TcaC, TcdB1, and TcdB2 from *Photorhabus*, XptC1$_{wi}$ and XptB1$_{xb}$ from *Xenorhabdus*, PptB1$_{1529}$ from *Paenibacillus* (the protein product of ORF5 of *Paenibacillus* strain DAS1529), and SepB from *Serratia entomophila* (GenBank Accession No. AAG09643.1; reproduced here as SEQ ID NO:11). Class B TC proteins are typically in the size range of about 170 kDa. Further examples of Class B TC proteins are TcaC homologs from *Pseudomonas syringae* pv. *syringae* B728a (GenBank Accession Numbers gi23472544 and gi23059431), and *X. nematophilus* PO ORF268 (encoded by bases 258-1991 of FIG. 2 of WO 20/004855). A preferred Class B TC protein is TcdB2 (SEQ ID NO:6). Class B TC proteins can be ~130-180 kDa, ~140-170 kDa, ~150-165 kDa, and ~155 kDa, for example.

In addition to those specifically identified in SEQ ID NOs: 5-11, Class B TC proteins include, for example:
 1) proteins obtained from wild type organisms;
 2) variants arising from mutations;
 3) variants designed by making conservative amino acid substitutions; and
 4) variants produced by random fragmentation and reassembly of a plurality of different sequences that encode Class B TC proteins (DNA shuffling).

See e.g. U.S. Pat. No. 5,605,793.

The DNA sequences encoding the Class B TC proteins can be wild type sequences, mutant sequences, or synthetic sequences designed to express a predetermined Class B TC protein. DNA sequences designed to be highly expressed in plants by, for example, avoiding polyadenylation signals, and using plant preferred codons, are particularly useful.

As used herein a "Class C TC protein" is a 90-112 kDa potentiator having an amino acid sequence with at least 35% identity to a sequence selected from the group consisting of
 TccC1 (SEQ ID NO:12),
 TccC2 (SEQ ID NO:13),
 TccC3 (SEQ ID NO:14),
 TccC4 (SEQ ID NO:15),
 TccC5 (SEQ ID NO:16),
 XptB1$_{wi}$ (SEQ ID NO:17),
 XPtC1$_{xb}$ (SEQ ID NO:18),
 PptC1(long) (SEQ ID NO:19),
 PptC1(short) (SEQ ID NO:20), and
 SepC (SEQ ID NO:21);
said protein being capable of increasing the toxicity of a Class A TC protein when used in combination with a Class B TC protein.

Table 3 provides sequence identity comparisons for known Class C TC proteins. The comparisons demonstrate that 35% sequence identity is an appropriate criterion in defining Class C TC proteins.

TABLE 3

Sequence identity comparisons for known Class C TC proteins.

| | TccC1 % Identity | TccC2 % Identity | TccC3 % Identity | TccC4 % Identity | TccC5 % Identity | XptB1$_{wi}$ % Identity | XptC1$_{xb}$ % Identity | PptC1 (Orf6 long) % Identity | PptC1 (Orf6 short) % Identity | SepC % Identity |
|---|---|---|---|---|---|---|---|---|---|---|
| *Photorhabdus luminescens* C Class | | | | | | | | | | |
| TccC1 | 100.0 | 48.1 | 52.8 | 52.9 | 51.3 | 45.5 | 46.5 | 35.0 | 35.7 | 44.1 |
| TccC2 | | 100.0 | 52.5 | 53.7 | 61.4 | 44.1 | 47.2 | 35.3 | 36.1 | 46.1 |
| TccC3 | | | 100.0 | 59.5 | 58.4 | 46.0 | 48.1 | 35.4 | 36.1 | 46.6 |
| TccC4 | | | | 100.0 | 57.2 | 44.8 | 49.1 | 36.9 | 37.7 | 45.3 |
| TccC5 | | | | | 100.0 | 45.6 | 48.7 | 35.2 | 36.0 | 44.9 |

TABLE 3-continued

Sequence identity comparisons for known Class C TC proteins.

| | TccC1 % Identity | TccC2 % Identity | TccC3 % Identity | TccC4 % Identity | TccC5 % Identity | XptB1$_{wi}$ % Identity | XptC1$_{xb}$ % Identity | PptC1 (Orf6 long) % Identity | PptC1 (Orf6 short) % Identity | SepC % Identity |
|---|---|---|---|---|---|---|---|---|---|---|
| *Xenorhabdus nematophilus* xwi C Class | | | | | | | | | | |
| XptB1$_{wi}$ | | | | | | 100.0 | 41.4 | 32.7 | 33.5 | 46.3 |
| *Xenorhabdus bovienii* C Class | | | | | | | | | | |
| XptC1$_{xb}$ | | | | | | | 100.0 | 35.4 | 36.2 | 43.5 |
| *Paenibacillus* spp str 1529 C Class | | | | | | | | | | |
| PptC1 (Orf6 long) | | | | | | | | 100.0 | 97.6 | 34.9 |
| PptC1 (Orf6 short) | | | | | | | | | 100.0 | 35.7 |
| *Serratia entomophila* C Class | | | | | | | | | | |
| SepC | | | | | | | | | | 100.0 |

A typical Class C TC protein is encoded by a polynucleotide that hybridizes under stringent conditions with a nucleic acid of one of SEQ ID NOs:34-42. Stated another way, a Class C polypeptide component of the subject invention can be encoded by a polynucleotide that hybridizes with the complement of a polynucleotide that codes for a polypeptide selected from SEQ ID NOs:12-21. It should be noted that DNA sequences can be optimized, for example, for expression in plants, and that some degree of variation is within the subject invention.

Examples of the Class C TC proteins are set forth herein in SEQ ID NOs:12-21. The examples include TccC1 and TccC3 from *Photorhabdus*, XptB1$_{wi}$ and XptC1$_{xb}$ from *Xenorhabdus*, PptC1$_{1529}$ from *Paenibacillus* (the protein product of ORF6 of *Paenibacillus* strain DAS1529), and SepC from *Serratia entomophila* (GenBank Accession No. AAG09644.1; reproduced here as SEQ ID NO:21). Proteins in this class are typically in the size range of about 112 kDa. Further examples of Class C TC proteins are TccC homologs from *Pseudomonas syringae* pv. *syringae* B728a (GenBank Accession Numbers gi:23470227, gi:23472546, gi:23472540, gi:23472541, gi:23468542, gi:23472545, gi:23058175, gi:23058176, gi:23059433, gi:23059435, and gi:23059432). A preferred Class C TC protein is TccC3 (SEQ ID NO:14). Class C TC proteins can be ~90-120 kDa, ~95-115 kDa, ~100-110 kDa, and ~105-107 kDa, for example.

In addition to those specifically identified in SEQ ID NOs: 12-21, Class C TC proteins include:

1) proteins obtained from wild type organisms;
2) variants arising from mutations;
3) variants designed by making conservative amino acid substitutions; and
4) variants produced by random fragmentation and reassembly of a plurality of different Class C coding sequences (DNA shuffling).

The DNA sequences encoding the Class C TC proteins can be wild type sequences, mutant sequences, or synthetic sequences designed to express a predetermined Class C TC protein. DNA sequences designed to be highly expressed in plants by, for example, avoiding polyadenylation signals, and using plant preferred codons, are particularly useful.

Some further examples of components for use according to the subject invention (and their relatedness to each other) include:

Class A Proteins

*Photorhabdus* TcdA toxin homologs

| Name | Reference | Sequence identity to W-14 TcdA (GenBank Accession NO. AAF05542.1) |
|---|---|---|
| P.l.Hph2 | SEQ ID NO: 13 of U.S. 6,281,413B1 | ~93% |
| P.l. Hph3 | Encoded by bases 2416 to 9909 of SEQ ID NO: 11 of U.S. 6,281,413B1 | ~57% |

*Photorhabdus* TcbA toxin homologs

| Name | Reference | Sequence identity to W-14 TcdA (GenBank Accession NO. AAF05542.1) |
|---|---|---|
| P.l. W-14 TcbA | GenBank Accession No. AAC38627.1 (reproduced here as SEQ ID NO: 24) | (~50% sequence identity to W-14 TcdA) |

*Xenorhabdus* XptA1 toxin homologs

| Name | Reference | Sequence identity to Xwi XptA1 (disclosed herein as SEQ ID NO: 22) |
|---|---|---|
| X.n XptA1 | GenBank Accession No. CAC38401.1 (AJ308438) | ~96% |

*Xenorhabdus* XptA2 toxin homologs

| Name | Reference | Sequence identity to Xwi XptA2 (disclosed herein as SEQ ID NO: 23) |
|---|---|---|
| X.n. XptA2 | GenBank Accession No. CAC38404.1 (AJ308438) | ~95% |

Class B TC Proteins

*Photorhabdus* ~170 kDa Potentiators

| Name | Identifier | Sequence identity to TcdB (GenBank Accession No. AAL18487.1) |
|---|---|---|
| P.1. ORF2 | SEQ ID NO: 14 of U.S. 6,281,413B1 | ~93% |
| P.1. ORF4 | Encoded by bases 9966 to 14633 of SEQ ID NO: 11 of U.S. 6,281,413B1 | ~71% |

*Xenorhabdus* ~170 kDa Potentiators

| Name | Identifier | Sequence identity to XptC1$_{wi}$ (disclosed herein as SEQ ID NO: 8) |
|---|---|---|
| X.n. XptC1 | GenBank Accession No. CAC38403.1 | ~90% |

Class C TC Proteins

*Photorhabdus* ~112 kDa Potentiators

| Name | Identifier | Sequence identity to TccC1 (GenBank Accession No. AAC38630.1) |
|---|---|---|
| P.1. ORF5 | SEQ ID NO: 12 of U.S. 6,281,413B1 | ~51% |

*Xenorhabdus* ~112 kDa Potentiators

| Name | Identifier | Sequence identity to XptB1$_{wi}$ (disclosed herein as SEQ ID NO: 17) |
|---|---|---|
| X.n. XptB1 | GenBank Accession No. CAC38402 | ~96% |
| X.nem. P2-ORF 2071 | Encoded by bases 2071 to 4929 of FIG. 2 of WO 20/004855 | ~48% |

Certain Class A, Class B, and Class C TC proteins useful in the fusion protein of the present invention have been specifically exemplified herein. As these proteins are merely exemplary of the proteins useful in the subject invention, it should be readily apparent that the subject invention comprises use of variant or equivalent proteins (and nucleotide sequences coding for equivalents thereof) having the same or similar functionality as the exemplified proteins. Equivalent proteins will have amino acid similarity (and/or homology) with an exemplified TC protein. Preferred polynucleotides and proteins of the subject invention can be defined in terms of narrower identity and/or similarity ranges. For example, the identity and/or similarity of the Class A, B, and/or C TC protein can be 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% as compared to a sequence exemplified or suggested herein and, the identity and/or similarity of the Class C TC protein can be 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99% as compared to a sequence exemplified or suggested herein. Any number listed above can be used to define the upper and lower limits. For example, a Class B component of a fusion protein of the subject invention can be defined as having 50-90% identity with a given TcdB protein. Thus, a TcdB-like protein (and/or a tcdB-like gene) can be defined by any numerical identity score provided or suggested herein, as compared to any previously known TcdB protein, including any TcdB protein (and likewise with PptB or corresponding *Xenorhabdus* proteins) specifically exemplified herein.

The amino acid homology/similarity/identity will typically (but not necessarily) be highest in regions of the protein that account for its activity or that are involved in the determination of three-dimensional configurations that are ultimately responsible for the activity. In this regard, certain amino acid substitutions are acceptable and can be expected to be tolerated. For example, these substitutions can be in regions of the protein that are not critical to activity. Analyzing the crystal structure of a protein, and software-based protein structure modeling, can be used to identify regions of a protein that can be modified (using site-directed mutagenesis, shuffling, etc.) to actually change the properties and/or increase the functionality of the protein.

Various properties and three-dimensional features of the protein can also be changed without adversely affecting the toxin activity/functionality of the protein. Conservative amino acid substitutions can be expected to be tolerated/to not adversely affect the three-dimensional configuration of the molecule. Amino acids can be placed in the following classes: non-polar, uncharged polar, basic, and acidic. Conservative substitutions whereby an amino acid of one class is replaced with another amino acid of the same type fall within the scope of the subject invention so long as the substitution is not adverse to the biological activity of the compound. Table 4 provides a listing of examples of amino acids belonging to each class.

TABLE 4

Classes of amino acids.

| Class of Amino Acid | Examples of Amino Acids |
|---|---|
| Nonpolar | Ala, Val, Leu, Ile, Pro, Met, Phe, Trp |
| Uncharged Polar | Gly, Ser, Thr, Cys, Tyr, Asn, Gln |
| Acidic | Asp, Glu |
| Basic | Lys, Arg, His |

In some instances, non-conservative substitutions can also be made. The critical factor is that these substitutions must not significantly detract from the functional/biological/toxin activity of the protein.

Equivalent Class A, Class B, and/or Class C TC proteins and/or genes encoding these equivalent proteins can be obtained/derived from wild-type or recombinant bacteria and/or from other wild-type or recombinant organisms using the teachings provided herein. Other *Bacillus, Serratia, Paenibacillus, Photorhabdus*, and *Xenorhabdus* species, for example, can be used as source isolates.

There are a number of methods for obtaining the proteins for use according to the subject invention. For example, antibodies to the proteins disclosed herein can be used to identify and isolate other proteins from a mixture. Specifically, antibodies may be raised to the portions of the proteins which are most constant and most distinct from other proteins. These antibodies can then be used to specifically identify equivalent proteins with the characteristic activity by immunoprecipitation, enzyme linked immunosorbent assay (ELISA), or immuno-blotting. Antibodies to the proteins disclosed herein, or to equivalent proteins, or to fragments of these proteins, can be readily prepared using standard procedures. Such antibodies are an aspect of the subject invention. Proteins of the subject invention can be obtained from a variety of sources/source microorganisms.

One skilled in the art would readily recognize that proteins (and genes) of the subject invention can be obtained from a variety of sources. A protein "from" or "obtainable from" any of the subject isolates referred to or suggested herein means that the protein (or a similar protein) can be obtained from the isolate or some other source, such as another bacterial strain or a plant. "Derived from" also has this connotation, and includes proteins obtainable from a given type of bacterium that are modified for expression in a plant, for example. One skilled in the art will readily recognize that, given the disclosure of a bacterial gene and protein, a plant can be engineered to produce the protein. Antibody preparations, nucleic acid probes (DNA and RNA), and the like may be prepared using the polynucleotide and/or amino acid sequences disclosed herein and used to screen and recover other protein genes from other (natural) sources.

Proteins and genes for use according to the subject invention can be identified and obtained by using oligonucleotide probes, for example. These probes are detectable nucleotide sequences which may be detectable by virtue of an appropriate label or may be made inherently fluorescent as described in International Application No. WO 93/16094. The probes (and the polynucleotides of the subject invention) may be DNA, RNA, or PNA. In addition to adenine (A), cytosine (C), guanine (G), thymine (T), and uracil (U; for RNA molecules), synthetic probes (and polynucleotides) of the subject invention can also have inosine (a neutral base capable of pairing with all four bases; sometimes used in place of a mixture of all four bases in synthetic probes). Thus, where a synthetic, degenerate oligonucleotide is referred to herein, and "N" or "n" is used generically, "N" or "n" can be G, A, T, C, or inosine. Ambiguity codes as used herein are in accordance with standard IUPAC naming conventions as of the filing of the subject application (for example, R means A or G, Y means C or T, etc.).

As is well known in the art, if a probe molecule hybridizes with a nucleic acid sample, it can be reasonably assumed that the probe and sample have substantial homology/similarity/identity. Preferably, hybridization of the polynucleotide is first conducted followed by washes under conditions of low, moderate, or high stringency by techniques well-known in the art, as described in, for example, Keller, G. H., M. M. Manak (1987) *DNA Probes*, Stockton Press, New York, N.Y., pp. 169-170. For example, as stated therein, low stringency conditions can be achieved by first washing with 2×SSC (Standard Saline Citrate)/0.1% SDS (Sodium Dodecyl Sulfate) for 15 minutes at room temperature. Two washes are typically performed. Higher stringency can then be achieved by lowering the salt concentration and/or by raising the temperature. For example, the wash described above can be followed by two washings with 0.1×SSC/0.1% SDS for 15 minutes each at room temperature followed by subsequent washes with 0.1× SSC/0.1% SDS for 30 minutes each at 55° C. These temperatures can be used with other hybridization and wash protocols set forth herein and as would be known to one skilled in the art (SSPE can be used as the salt instead of SSC, for example). The 2×SSC/0.1% SDS can be prepared by adding 50 ml of 20×SSC and 5 ml of 10% SDS to 445 ml of water. 20×SSC can be prepared by combining NaCl (175.3 g/0.150 M), sodium citrate (88.2 g/0.015 M), and water, adjusting pH to 7.0 with 10 N NaOH, then adjusting the volume to 1 liter 10% SDS can be prepared by dissolving 10 g of SDS in 50 ml of autoclaved water, then diluting to 100 ml.

Detection of the probe provides a means for determining in a known manner whether hybridization has been maintained. Such a probe analysis provides a rapid method for identifying toxin-encoding genes of the subject invention. The nucleotide segments which are used as probes according to the invention can be synthesized using a DNA synthesizer and standard procedures. These nucleotide sequences can also be used as PCR primers to amplify genes of the subject invention.

Hybridization with a given wild type nucleic acids encoding Class A, Class B, and Class C TC proteins (for example, SEQ ID NOs:28-42 and 61-66) is a technique that can be used to find and/or define Class A, Class B, and Class C TC proteins, which will be useful in fusion proteins of the invention. As used herein, "stringent" conditions for hybridization refers to conditions which achieve the same, or about the same, degree of specificity of hybridization as the conditions employed by the current applicants. Specifically, hybridization of immobilized DNA on Southern blots with $^{32}$P-labeled gene-specific probes was performed by standard methods (see, e.g., Maniatis, T., E. F. Fritsch, J. Sambrook [1982] *Molecular Cloning: A Laboratory Manual*, Cold Spring Harbor Laboratory, Cold Spring Harbor, N.Y.). In general, hybridization and subsequent washes were carried out under conditions that allowed for detection of target sequences. For double-stranded DNA gene probes, hybridization was carried out overnight at 20-25° C. below the melting temperature (Tm) of the DNA hybrid in 6×SSPE, 5× Denhardt's solution, 0.1% SDS, 0.1 mg/ml denatured DNA. The melting temperature is described by the following formula (Beltz, G. A., K. A. Jacobs, T. H. Eickbush, P. T. Cherbas, and F. C. Kafatos [1983] *Methods of Enzymology*, R. Wu, L. Grossman and K. Moldave [eds.] Academic Press, New York 100:266-285):

1) Tm=81.50° C.+16.6 Log[Na+]+0.41(%G+C)−0.61(% formamide)−600/length of duplex in base pairs.
2) Washes are typically carried out as follows:
3) Twice at room temperature for 15 minutes in 1×SSPE, 0.1% SDS (low stringency wash).
4) Once at Tm-20° C. for 15 minutes in 0.2×SSPE, 0.1% SDS (moderate stringency wash).

For oligonucleotide probes, hybridization was carried out overnight at 10-20° C. below the melting temperature (Tm) of the hybrid in 6×SSPE, 5× Denhardt's solution, 0.1% SDS, 0.1 mg/ml denatured DNA. Tm for oligonucleotide probes was determined by the following formula: Tm (° C.)=2(number T/A base pairs)+4(number G/C base pairs) (Suggs, S. V., T. Miyake, E. H. Kawashime, M. J. Johnson, K. Itakura, and R. B. Wallace [1981] *ICN-UCLA Symp. Dev. Biol. Using Purified Genes*, D. D. Brown [ed.], Academic Press, New York, 23:683-693).

Washes were typically carried out as follows:
1) Twice at room temperature for 15 minutes 1×SSPE, 0.1% SDS (low stringency wash).
2) Once at the hybridization temperature for 15 minutes in 1×SSPE, 0.1% SDS (moderate stringency wash).

In general, salt and/or temperature can be altered to change stringency. With a labeled DNA fragment >70 or so bases in length, the following conditions can be used:
1) Low: 1 or 2×SSPE, room temperature
2) Low: 1 or 2×SSPE, 42° C.
3) Moderate: 0.2× or 1×SSPE, 65° C.
4) High: 0.1×SSPE, 65° C.

Duplex formation and stability depend on substantial complementarity between the two strands of a hybrid, and, as noted above, a certain degree of mismatch can be tolerated. Therefore, the probe sequences of the subject invention include mutations (both single and multiple), deletions, insertions of the described sequences, and combinations thereof, wherein said mutations, insertions and deletions permit formation of stable hybrids with the target polynucleotide of interest. Mutations, insertions, and deletions can be produced in a given polynucleotide sequence in many ways, and these methods are known to an ordinarily skilled artisan. Other methods may become known in the future.

PCR Technology. Polymerase Chain Reaction (PCR) is a repetitive, enzymatic, primed synthesis of a nucleic acid sequence. This procedure is well known and commonly used by those skilled in this art (see Mullis, U.S. Pat. Nos. 4,683,195, 4,683,202, and 4,800,159; Saiki, Randall K., Stephen Scharf, Fred Faloona, Kary B. Mullis, Glenn T. Horn, Henry A. Erlich, Norman Arnheim [1985] "Enzymatic Amplification of β-Globin Genomic Sequences and Restriction Site Analysis for Diagnosis of Sickle Cell Anemia," *Science* 230: 1350-1354). PCR is based on the enzymatic amplification of a DNA fragment of interest that is flanked by two oligonucleotide primers that hybridize to opposite strands of the target sequence. The primers are oriented with the 3' ends pointing towards each other. Repeated cycles of heat denaturation of the template, annealing of the primers to their complementary sequences, and extension of the annealed primers with a DNA polymerase result in the amplification of the segment defined by the 5' ends of the PCR primers. The extension product of each primer can serve as a template for the other primer, so each cycle essentially doubles the amount of DNA fragment produced in the previous cycle. This results in the exponential accumulation of the specific target fragment, up to several million-fold in a few hours. By using a thermostable DNA polymerase such as Taq polymerase, isolated from the thermophilic bacterium *Thermus aquaticus*, the amplification process can be completely automated. Other enzymes that can be used are known to those skilled in the art.

The DNA sequences of the subject invention can be used as primers for PCR amplification. In performing PCR amplification, a certain degree of mismatch can be tolerated between primer and template. Therefore, mutations, deletions, and insertions (especially additions of nucleotides to the 5' end) of the exemplified primers fall within the scope of the subject invention. Mutations, insertions, and deletions can be produced in a given primer by methods known to an ordinarily skilled artisan.

Modification of Genes and Proteins. The genes and proteins useful according to the subject invention include not only the specifically exemplified full-length sequences, but also portions, segments and/or fragments (including internal and/or terminal deletions compared to the full-length molecules) of these sequences, variants, mutants, chimerics, and fusions thereof. Proteins used in the subject invention can have substituted amino acids so long as they retain the characteristic pesticidal/functional activity of the proteins specifically exemplified herein. "Variant" genes have nucleotide sequences that encode the same proteins or equivalent proteins having functionality equivalent to an exemplified protein. The terms "variant proteins" and "equivalent proteins" refer to proteins having the same or essentially the same biological/functional activity as the exemplified proteins. As used herein, reference to an "equivalent" sequence refers to sequences having amino acid substitutions, deletions, additions, or insertions that improve or do not adversely affect functionality. Fragments retaining functionality are also included in this definition. Fragments and other equivalents that retain the same or similar function, as a corresponding fragment of an exemplified protein are within the scope of the subject invention. Changes, such as amino acid substitutions or additions, can be made for a variety of purposes, such as increasing (or decreasing) protease stability of the protein (without materially/substantially decreasing the functionality of the protein).

Variations of genes may be readily constructed using standard techniques for making point mutations, for example. In addition, U.S. Pat. No. 5,605,793, for example, describes methods for generating additional molecular diversity by using DNA reassembly after random fragmentation. Variant genes can be used to produce variant proteins; recombinant hosts can be used to produce the variant proteins. Using these "gene shuffling" techniques, equivalent genes and proteins can be constructed that comprise any 5, 10, or 20 contiguous residues (amino acid or nucleotide) of any sequence exemplified herein.

Fragments of full-length genes can be made using commercially available exonucleases or endonucleases according to standard procedures. For example, enzymes such as Bal31 or site-directed mutagenesis can be used to systematically cut off nucleotides from the ends of these genes. Also, genes that encode active fragments may be obtained using a variety of restriction enzymes. Proteases may be used to directly obtain active fragments of these proteins.

It is within the scope of the invention as disclosed herein that TC proteins may be truncated and still retain functional activity. By "truncated protein" is meant that a portion of a protein may be cleaved and yet still exhibit activity after cleavage. Cleavage can be achieved by proteases inside or outside of the insect gut. Furthermore, effectively cleaved proteins can be produced using molecular biology techniques wherein the DNA bases encoding said protein are removed either through digestion with restriction endonucleases or other techniques available to the skilled artisan. After truncation, said proteins can be expressed in heterologous systems such as *E. coli*, baculoviruses, plant-based viral systems, yeast and the like and then placed in insect assays as disclosed herein to determine activity. It is well-known in the art that truncated proteins can be successfully produced so that they retain functional activity while having less than the entire, full-length sequence. It is well known in the art that B.t. toxins can be used in a truncated (core toxin) form. See, e.g., Adang et al., *Gene* 36:289-300 (1985), "Characterized full-length and truncated plasmid clones of the crystal protein of *Bacillus thuringiensis* subsp *kurstaki* HD-73 and their toxicity to *Manduca sexta*." There are other examples of truncated proteins that retain insecticidal activity, including the insect juvenile hormone esterase (U.S. Pat. No. 5,674,485 to the Regents of the University of California). As used herein, the term "toxin" is also meant to include functionally active truncations.

Because of the degeneracy/redundancy of the genetic code, a variety of different DNA sequences can encode the amino acid sequences disclosed herein. It is well within the skill of a person trained in the art to create alternative DNA sequences that encode the same, or essentially the same, toxins. These variant DNA sequences are within the scope of the subject invention.

Optimization of Sequence for Expression in Plants. To obtain high expression of heterologous genes in plants it may be preferred to reengineer said genes so that they are more efficiently expressed in (the cytoplasm of) plant cells. Maize is one such plant where it may be preferred to re-design the heterologous gene(s) prior to transformation to increase the expression level thereof in said plant. Therefore, an additional step in the design of genes encoding a bacterial toxin is reengineering of a heterologous gene for optimal expression. Guidance regarding the production of synthetic genes that are optimized for plant expression can be found in, for example, U.S. Pat. No. 5,380,831. SEQ ID NOs:43 and 44 give examples of plant-optimized sequences encoding Class B TC protein TcdB2 and Class C TC protein TccC3.

Function, Activity, and Utility. The present invention provides easily administered, functional proteins. The present invention also provides a method for delivering insecticidal proteins that are functionally active and effective against many orders of insects, preferably lepidopteran and/or coleopteran insects. By "functional activity" (or "active against") it is meant herein that the proteins function as orally active insect control agents (alone or in combination with other proteins), that the proteins have a toxic effect (alone or in combination with other proteins), or are able to disrupt or deter insect growth and/or feeding which may or may not cause death of the insect. When an insect comes into contact with an "effective amount" of a "insecticidal protein" of the subject invention delivered via transgenic plant expression, formulated protein composition(s), sprayable protein composition(s), a bait matrix or other delivery system, the results are typically death of the insect, inhibition of the growth and/or proliferation of the insect, and/or prevention of the insects from feeding upon the source (preferably a transgenic plant) that makes the proteins available to the insects. Thus, insects that ingest an effective amount of ABC fusion protein, for example, can be deterred from feeding, have their growth stunted, and/or be killed, for example. A "BC" fusion protein of the invention has "functionality" or toxin activity if it enhances the functional activity of a Class A TC protein when used in combination therewith.

Complete lethality to feeding insects is preferred, but is not required to achieve functional activity. If an insect avoids the protein or ceases feeding, that avoidance will be useful in some applications, even if the effects are sublethal or lethality is delayed or indirect. For example, if insect resistant transgenic plants are desired, the reluctance of insects to feed on the plants is as useful as lethal toxicity to the insects because the ultimate objective is avoiding insect-induced plant damage.

Transfer of the functional activity to plant or bacterial systems typically requires nucleic acid sequences, encoding the amino acid sequences for the toxins, integrated into a protein expression vector appropriate to the host in which the vector will reside. One way to obtain a nucleic acid sequence encoding a protein with functional activity is to isolate the native genetic material from the bacterial species which produce the toxins, using information deduced from the toxin's amino acid sequence, as disclosed herein. The native sequences can be optimized for expression in plants, for example, as discussed in more detail below. Optimized polynucleotide can also be designed based on the protein sequence.

There are many other ways in which TC proteins can be incorporated into an insect's diet. For example, it is possible to adulterate the larval food source with the toxic protein by spraying the food with a protein solution, as disclosed herein. Alternatively, the purified protein could be genetically engineered into an otherwise harmless bacterium, which could then be grown in culture, and either applied to the food source or allowed to reside in the soil in an area in which insect eradication was desirable. Also, the protein could be genetically engineered directly into an insect food source. For instance, the major food source for many insect larvae is plant material. Therefore the genes encoding toxins can be transferred to plant material so that said plant material expresses the toxin of interest.

Transgenic Hosts. The genes encoding Toxin Complex fusions of the subject invention can be introduced into a wide variety of microbial or plant hosts. In preferred embodiments, transgenic plant cells and plants are used. Preferred plants (and plant cells) are corn (maize), cotton, canola, sunflowers, and soybeans.

In preferred embodiments, expression of the fusion gene results, directly or indirectly, in the intracellular production (and maintenance) of the fusion protein. Plants can be rendered insect-resistant in this manner. When transgenic/recombinant/transformed/transfected host cells (or contents thereof) are ingested by the pests, the pests will ingest the toxin. This is the preferred manner in which to cause contact of the pest with the toxin. The result is control (killing or making sick) of the pest. Sucking pests can also be controlled in a similar manner. Alternatively, suitable microbial hosts, e.g., *Pseudomonas* such as *P. fluorescens*, can be applied where target pests are present; the microbes can proliferate there, and are ingested by the target pests. The microbe hosting the toxin gene can be treated under conditions that prolong the activity of the toxin and stabilize the cell. The treated cell, which retains the toxic activity, can then be applied to the environment of the target pest. The subject invention also includes the administration of cells producing less than all three types of TC polypeptides. In some embodiments, this could include the co-administration of cells producing Toxin A and cells producing a BC fusion protein of the subject invention, for example.

Where the toxin gene is introduced via a suitable vector into a microbial host, and said host is applied to the environment in a living state, certain host microbes should be used. Microorganism hosts are selected which are known to occupy the "phytosphere" (phylloplane, phyllosphere, rhizosphere, and/or rhizoplane) of one or more crops of interest. These microorganisms are selected so as to be capable of successfully competing in the particular environment (crop and other insect habitats) with the wild-type microorganisms, provide for stable maintenance and expression of the gene expressing the polypeptide pesticide, and, desirably, provide for improved protection of the pesticide from environmental degradation and inactivation.

A large number of microorganisms are known to inhabit the phylloplane (the surface of the plant leaves) and/or the rhizosphere (the soil surrounding plant roots) of a wide variety of important crops. These microorganisms include bacteria, algae, and fungi. Of particular interest are microorganisms, such as bacteria, e.g., genera *Pseudomonas, Erwinia, Serratia, Klebsiella, Xanthomonas, Streptomyces, Rhizobium, Rhodopseudomonas, Methylophilius, Agrobacterium, Acetobacter, Lactobacillus, Arthrobacter, Azotobacter, Leuconostoc*, and *Alcaligenes*; fungi, particularly yeast, e.g., genera *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas fluorescens, Serratia marcescens, Acetobacter xylinum, Agrobacterium tumefaciens, Rhodopseudomonas spheroides, Xanthomonas campestris, Rhizobium melioti, Alcaligenes entrophus*, and *Azotobacter vinlandii*; and phytosphere yeast species such as *Rhodotorula rubra, R. glutinis, R. marina, R. aurantiaca, Cryptococcus albidus, C. diffluens, C. laurentii, Saccharomyces rosei, S. pretoriensis, S. cerevisiae, Sporobolomyces roseus, S. odorus, Kluyveromyces veronae*, and *Aureobasidium pollulans*. Also of interest are pigmented microorganisms.

Insertion of Genes to Form Transgenic Hosts. One aspect of the subject invention is the transformation/transfection of plants, plant cells, and other host cells with polynucleotides of the subject invention that express proteins of the subject invention. Plants transformed in this manner can be rendered resistant to attack by the target pest(s).

A wide variety of methods are available for introducing a gene encoding a protein into the target host under conditions that allow for stable maintenance and expression of the gene. These methods are well known to those skilled in the art and are described, for example, in U.S. Pat. No. 5,135,867.

For example, a large number of cloning vectors comprising a replication system in *E. coli* and a marker that permits selection of the transformed cells are available for preparation for the insertion of foreign genes into higher plants. The vectors comprise, for example, pBR322, pUC series, M13mp series, pACYC184, etc. Accordingly, the sequence encoding the toxin can be inserted into the vector at a suitable restriction site. The resulting plasmid is used for transformation into *E. coli*. The *E. coli* cells are cultivated in a suitable nutrient medium, then harvested and lysed. The plasmid is recovered. Sequence analysis, restriction analysis, electrophoresis, and other biochemical-molecular biological methods are generally carried out as methods of analysis. After each manipulation, the DNA sequence used can be cleaved and joined to the next DNA sequence. Each plasmid sequence can be cloned in the same or other plasmids. Depending on the method of inserting desired genes into the plant, other DNA sequences may be necessary. If, for example, the Ti or Ri plasmid is used for the transformation of the plant cell, then at least the right border, but often the right and the left border of the Ti or Ri plasmid T-DNA, has to be joined as the flanking region of the genes to be inserted. The use of T-DNA for the transformation of plant cells has been intensively researched and described in EP 120 516; Hoekema (1985) In: *The Binary Plant Vector System*, Offset-durkkerij Kanters B. V., Alblasserdam, Chapter 5; Fraley et al., *Crit. Rev. Plant Sci.* 4:1-46; and An et al. (1985) *EMBO J.* 4:277-287.

A large number of techniques are available for inserting DNA into a plant host cell. Those techniques include transformation with T-DNA using *Agrobacterium tumefaciens* or *Agrobacterium rhizogenes* as transformation agent, fusion, injection, biolistics (microparticle bombardment), or electroporation as well as other possible methods. If *Agrobacterium* are used for the transformation, the DNA to be inserted has to be cloned into special plasmids, namely either into an intermediate vector or into a binary vector. The intermediate vectors can be integrated into the Ti or Ri plasmid by homologous recombination owing to sequences that are homologous to sequences in the T-DNA. The Ti or Ri plasmid also comprises the vir region necessary for the transfer of the T-DNA. Intermediate vectors cannot replicate themselves in *Agrobacterium*. The intermediate vector can be transferred into *Agrobacterium tumefaciens* by means of a helper plasmid (conjugation). Binary vectors can replicate themselves both in *E. coli* and in *Agrobacterium*. They comprise a selection marker gene and a linker or polylinker which are framed by the right and left T-DNA border regions. They can be transformed directly into *Agrobacterium* (Holsters et al [1978] *Mol. Gen. Genet.* 163:181-187). The *Agrobacterium* used as host cell is to comprise a plasmid carrying a vir region. The vir region is necessary for the transfer of the T-DNA into the plant cell. Additional T-DNA may be contained. The bacterium so transformed is used for the transformation of plant cells. Plant explants can advantageously be cultivated with *Agrobacterium tumefaciens* or *Agrobacterium rhizogenes* for the transfer of the DNA into the plant cell. Whole plants can then be regenerated from the infected plant material (for example, pieces of leaf, segments of stalk, roots, but also protoplasts or suspension-cultivated cells) in a suitable medium, which may contain antibiotics or biocides for selection. The plants so obtained can then be tested for the presence of the inserted DNA. No special demands are made of the plasmids in the case of injection and electroporation. It is possible to use ordinary plasmids, such as, for example, pUC derivatives.

The transformed cells grow inside the plants in the usual manner. They can form germ cells and transmit the transformed trait(s) to progeny plants. Such plants can be grown in the normal manner and crossed with plants that have the same transformed hereditary factors or other hereditary factors. The resulting hybrid individuals have the corresponding phenotypic properties.

In some preferred embodiments of the invention, genes encoding the bacterial toxin are expressed from transcriptional units inserted into the plant genome. Preferably, said transcriptional units are recombinant vectors capable of stable integration into the plant genome and enable selection of transformed plant lines expressing mRNA encoding the proteins.

Once the inserted DNA has been integrated in the genome, it is relatively stable there (and does not come out again). It normally contains a selection marker that confers on the transformed plant cells resistance to a biocide or an antibiotic, such as kanamycin, G418, bleomycin, hygromycin, or chloramphenicol, inter alia. The individually employed marker should accordingly permit the selection of transformed cells rather than cells that do not contain the inserted DNA. The gene(s) of interest are preferably expressed either by constitutive or inducible promoters in the plant cell. Once expressed, the mRNA is translated into proteins, thereby incorporating amino acids of interest into protein. The genes encoding a toxin expressed in the plant cells can be under the control of a constitutive promoter, a tissue-specific promoter, or an inducible promoter.

Several techniques exist for introducing foreign recombinant vectors into plant cells, and for obtaining plants that stably maintain and express the introduced gene. Such techniques include the introduction of genetic material coated onto microparticles directly into cells (U.S. Pat. No. 4,945,050 to Cornell and U.S. Pat. No. 5,141,131 to DowElanco, now Dow AgroSciences, LLC). In addition, plants may be transformed using *Agrobacterium* technology, see U.S. Pat. No. 5,177,010 to University of Toledo; U.S. Pat. No. 5,104,310 to Texas A&M; European Patent Application 0131624B1; European Patent Applications 120516, 159418B1 and 176,112 to Schilperoot; U.S. Pat. Nos. 5,149,645, 5,469,976, 5,464,763 and 4,940,838 and 4,693,976 to Schilperoot; European Patent Applications 116718, 290799, 320500 all to Max Planck; European Patent Applications 604662 and 627752, and U.S. Pat. No. 5,591,616, to Japan Tobacco; European Patent Applications 0267159 and 0292435, and U.S. Pat. No. 5,231,019, all to Ciba Geigy, now Novartis; U.S. Pat. Nos. 5,463,174 and 4,762,785, both to Calgene; and U.S. Pat. Nos. 5,004,863 and 5,159,135, both to Agracetus. Other transformation technology includes whiskers technology. See U.S. Pat. Nos. 5,302,523 and 5,464,765, both to Zeneca. Electroporation technology has also been used to transform plants. See WO 87/06614 to Boyce Thompson Institute; U.S. Pat. Nos. 5,472,869 and 5,384,253, both to Dekalb; and WO 92/09696 and WO 93/21335, both to Plant Genetic Systems. Furthermore, viral vectors can also be used to produce transgenic plants expressing the protein of interest. For example, monocotyledonous plant can be transformed with a viral vector using the methods described in U.S. Pat. No. 5,569,597 to Mycogen Plant Science and Ciba-Giegy, now Novartis, as well as U.S. Pat. Nos. 5,589,367 and 5,316,931, both to Biosource.

As mentioned previously, the manner in which the DNA construct is introduced into the plant host is not critical to this invention. Any method that provides for efficient transformation can be employed. For example, various methods for plant cell transformation are described herein and include the use of Ti or Ri-plasmids and the like to perform *Agrobacterium* mediated transformation. In many instances, it will be desirable to have the construct used for transformation bordered on one or both sides by T-DNA borders, more specifically the right border. This is particularly useful when the construct uses *Agrobacterium tumefaciens* or *Agrobacterium rhizogenes* as a mode for transformation, although T-DNA borders may find use with other modes of transformation. Where *Agrobacterium* is used for plant cell transformation, a vector may be used which may be introduced into the host for homologous recombination with T-DNA or the Ti or Ri plasmid present in the host. Introduction of the vector may be performed via electroporation, tri-parental mating and other techniques for transforming gram-negative bacteria which are known to those skilled in the art. The manner of vector transformation into the *Agrobacterium* host is not critical to this invention. The Ti or Ri plasmid containing the T-DNA for recombination may be capable or incapable of causing gall formation, and is not critical to said invention so long as the vir genes are present in said host.

In some cases where *Agrobacterium* is used for transformation, the expression construct being within the T-DNA borders will be inserted into a broad spectrum vector such as pRK2 or derivatives thereof as described in Ditta et al., (PNAS USA (1980) 77:7347-7351 and EPO 0 120 515, which are incorporated herein by reference. Included within the expression construct and the T-DNA will be one or more markers as described herein which allow for selection of transformed *Agrobacterium* and transformed plant cells. The particular marker employed is not essential to this invention, with the preferred marker depending on the host and construction used.

For transformation of plant cells using *Agrobacterium*, explants may be combined and incubated with the transformed *Agrobacterium* for sufficient time to allow transformation thereof. After transformation, the *Agrobacterium* are killed by selection with the appropriate antibiotic and plant cells are cultured with the appropriate selective medium. Once calli are formed, shoot formation can be encouraged by employing the appropriate plant hormones according to methods well known in the art of plant tissue culturing and plant regeneration. However, a callus intermediate stage is not always necessary. After shoot formation, said plant cells can be transferred to medium which encourages root formation thereby completing plant regeneration. The plants may then be grown to seed and said seed can be used to establish future generations. Regardless of transformation technique, the gene encoding a bacterial toxin is preferably incorporated into a gene transfer vector adapted to express said gene in a plant cell by including in the vector a plant promoter regulatory element, as well as 3' non-translated transcriptional termination regions such as Nos and the like.

In addition to numerous technologies for transforming plants, the type of tissue that is contacted with the foreign genes may vary as well. Such tissue would include but would not be limited to embryogenic tissue, callus tissue types I, II, and III, hypocotyl, meristem, root tissue, tissues for expression in phloem, and the like. Almost all plant tissues may be transformed during dedifferentiation using appropriate techniques described herein.

As mentioned above, a variety of selectable markers can be used, if desired. Preference for a particular marker is at the discretion of the artisan, but any of the following selectable markers may be used along with any other gene not listed herein which could function as a selectable marker. Such selectable markers include but are not limited to aminoglycoside phosphotransferase gene of transposon Tn5 (Aph II) which encodes resistance to the antibiotics kanamycin, neomycin and G418, as well as those genes which encode for resistance or tolerance to glyphosate; hygromycin; methotrexate; phosphinothricin (bialaphos); imidazolinones, sulfonylureas and triazolopyrimidine herbicides, such as chlorsulfuron; bromoxynil, dalapon and the like.

In addition to a selectable marker, it may be desirous to use a reporter gene. In some instances a reporter gene may be used with or without a selectable marker. Reporter genes are genes which are typically not present in the recipient organism or tissue and typically encode for proteins resulting in some phenotypic change or enzymatic property. Examples of such genes are provided in K. Wising et al. Ann. Rev. Genetics, 22, 421 (1988). Preferred reporter genes include the beta-glucuronidase (GUS) of the uidA locus of *E. coli*, the chloramphenicol acetyl transferase gene from Tn9 of *E. coli*, the green fluorescent protein from the bioluminescent jellyfish *Aequorea victoria*, and the luciferase genes from firefly *Photinus pyralis*. An assay for detecting reporter gene expression may then be performed at a suitable time after said gene has been introduced into recipient cells. A preferred such assay entails the use of the gene encoding beta-glucuronidase (GUS) of the uidA locus of *E. coli* as described by Jefferson et al., (1987 Biochem. Soc. Trans. 15, 17-19) to identify transformed cells.

In addition to plant promoter regulatory elements, promoter regulatory elements from a variety of sources can be used efficiently in plant cells to express foreign genes. For example, promoter regulatory elements of bacterial origin, such as the octopine synthase promoter, the nopaline synthase promoter, the mannopine synthase promoter; promoters of viral origin, such as the cauliflower mosaic virus (35S and 19S), 35T (which is a re-engineered 35S promoter, see U.S. Pat. No. 6,166,302, especially Example 7E) and the like may be used. Plant promoter regulatory elements include but are not limited to ribulose-1,6-bisphosphate (RUBP) carboxylase small subunit (ssu), beta-conglycinin promoter, beta-phaseolin promoter, ADH promoter, heat-shock promoters, and tissue specific promoters. Other elements such as matrix attachment regions, scaffold attachment regions, introns, enhancers, polyadenylation sequences and the like may be present and thus may improve the transcription efficiency or DNA integration. Such elements may or may not be necessary for DNA function, although they can provide better expression or functioning of the DNA by affecting transcription, mRNA stability, and the like. Such elements may be included in the DNA as desired to obtain optimal performance of the transformed DNA in the plant. Typical elements include but are not limited to Adh-intron 1, Adh-intron 6, the alfalfa mosaic virus coat protein leader sequence, the maize streak virus coat protein leader sequence, as well as others available to a skilled artisan. Constitutive promoter regulatory elements may also be used thereby directing continuous gene expression in all cells types and at all times (e.g., actin, ubiquitin, CaMV 35S, and the like). Tissue specific promoter regulatory elements are responsible for gene expression in specific cell or tissue types, such as the leaves or seeds (e.g., zein, oleosin, napin, ACP, globulin and the like) and these may also be used.

Promoter regulatory elements may also be active during a certain stage of the plant's development as well as active in plant tissues and organs. Examples of such include but are not limited to pollen-specific, embryo-specific, corn-silk-specific, cotton-fiber-specific, root-specific, seed-endosperm-specific promoter regulatory elements and the like. Under certain circumstances it may be desirable to use an inducible promoter regulatory element, which is responsible for expression of genes in response to a specific signal, such as: physical stimulus (heat shock genes), light (RUBP carboxylase), hormone (Em), metabolites, chemical, and stress. Other desirable transcription and translation elements that function in plants may be used. Numerous plant-specific gene transfer vectors are known in the art.

Standard molecular biology techniques may be used to clone and sequence the toxins described herein. Additional information may be found in Sambrook, J., Fritsch, E. F., and Maniatis, T. (1989), Molecular Cloning, A Laboratory Manual, Cold Spring Harbor Press, which is incorporated herein by reference.

Resistance Management. With increasing commercial use of insecticidal proteins in transgenic plants, one consideration is resistance management. That is, there are numerous companies using *Bacillus thuringiensis* toxins in their products, and there is concern about insects developing resistance to B.t. toxins. One strategy for insect resistance management would be to combine the TC insecticidal proteins produced by *Xenorhabdus, Photorhabdus*, and the like with toxins such as B.t. crystal toxins, soluble insecticidal proteins from *Bacillus* stains (see, e.g., WO 98/18932 and WO 99/57282), or other insect toxins. The combinations could be formulated for a sprayable application or could be molecular combinations. Plants could be transformed with bacterial genes that produce two or more different insect toxins (see, e.g., Gould, 38 *Bioscience* 26-33 (1988) and U.S. Pat. No. 5,500,365; likewise, European Patent Application 0 400 246 A1 and U.S. Pat. Nos. 5,866,784; 5,908,970; and 6,172,281 also describe transformation of a plant with two B.t. crystal toxins). Another method of producing a transgenic plant that contains more than one insect resistant gene would be to first produce two plants, with each plant containing an insect resistance gene. These plants could then be crossed using traditional plant breeding techniques to produce a plant containing more than one insect resistance gene. Thus, it should be apparent that the phrase "comprising a polynucleotide" as used herein means at least one polynucleotide (and possibly more, contiguous or not) unless specifically indicated otherwise.

Formulations and Other Delivery Systems. Formulated bait granules containing cells and/or proteins of the subject invention (including recombinant microbes comprising the genes described herein) can be applied to the soil. Formulated product can also be applied as a seed-coating or root treatment or total plant treatment at later stages of the crop cycle. Plant and soil treatments of cells may be employed as wettable powders, granules or dusts, by mixing with various inert materials, such as inorganic minerals (phyllosilicates, carbonates, sulfates, phosphates, and the like) or botanical materials (powdered corncobs, rice hulls, walnut shells, and the like). The formulations may include spreader-sticker adjuvants, stabilizing agents, other pesticidal additives, or surfactants. Liquid formulations may be aqueous-based or non-aqueous and employed as foams, gels, suspensions, emulsifiable concentrates, or the like. The ingredients may include rheological agents, surfactants, emulsifiers, dispersants, or polymers.

As would be appreciated by a person skilled in the art, the pesticidal concentration will vary widely depending upon the nature of the particular formulation, particularly whether it is a concentrate or to be used directly. The pesticide will be present in at least 1% by weight and may be 100% by weight. The dry formulations will have from about 1-95% by weight of the pesticide while the liquid formulations will generally be from about 1-60% by weight of the solids in the liquid phase. The formulations will generally have from about $10^2$ to about $10^4$ cells/mg. These formulations will be administered at about 50 mg (liquid or dry) to 1 kg or more per hectare.

The formulations can be applied to the environment of the pest, e.g., soil and foliage, by spraying, dusting, sprinkling, or the like.

Another delivery scheme is the incorporation of the genetic material of toxins into a baculovirus vector. Baculoviruses infect particular insect hosts, including those desirably targeted with the toxins. Infectious baculovirus harboring an expression construct for the toxins could be introduced into areas of insect infestation to thereby intoxicate or poison infected insects.

Insect viruses, or baculoviruses, are known to infect and adversely affect certain insects. The effect of the viruses on insects is slow, and viruses do not immediately stop the feeding of insects. Thus, viruses are not viewed as being optimal as insect pest control agents. However, combining the toxin genes into a baculovirus vector could provide an efficient way of transmitting the toxins. In addition, since different baculoviruses are specific to different insects, it may be possible to use a particular toxin to selectively target particularly damaging insect pests. A particularly useful vector for the toxins genes is the nuclear polyhedrosis virus. Transfer vectors using this virus have been described and are now the vectors of choice for transferring foreign genes into insects. The virus-toxin gene recombinant may be constructed in an orally transmissible form. Baculoviruses normally infect insect victims through the mid-gut intestinal mucosa. The toxin gene inserted behind a strong viral coat protein promoter would be expressed and should rapidly kill the infected insect.

In addition to an insect virus or baculovirus or transgenic plant delivery system for the protein toxins of the present invention, the proteins may be encapsulated using *Bacillus thuringiensis* encapsulation technology such as but not limited to U.S. Pat. Nos. 4,695,455; 4,695,462; 4,861,595 which are all incorporated herein by reference. Another delivery system for the protein toxins of the present invention is formulation of the protein into a bait matrix, which could then be used in above and below ground insect bait stations. Examples of such technology include but are not limited to PCT Patent Application WO 93/23998, which is incorporated herein by reference.

Plant RNA viral based systems can also be used to express bacterial toxin. In so doing, the gene encoding a toxin can be inserted into the coat promoter region of a suitable plant virus which will infect the host plant of interest. The toxin can then be expressed thus providing protection of the plant from insect damage. Plant RNA viral based systems are described in U.S. Pat. Nos. 5,500,360 to Mycogen Plant Sciences, Inc. and U.S. Pat. Nos. 5,316,931 and 5,589,367 to Biosource Genetics Corp.

In addition to producing a transformed plant, there are other delivery systems where it may be desirable to engineer the bacterial gene(s). For example, a protein toxin can be constructed by fusing together a molecule attractive to insects as a food source with a toxin. After purification in the laboratory such a toxic agent with "built-in" bait could be packaged inside standard insect trap housings.

Mutants. Mutants of bacterial isolates can be made by procedures that are well known in the art. For example, asporogenous mutants can be obtained through ethylmethane sulfonate (EMS) mutagenesis of an isolate. The mutants can be made using ultraviolet light and nitrosoguanidine by procedures well known in the art.

EXAMPLE 1

Construction of the Gene tcdB2/tccC3 V1

The coding regions for Toxin Complex potentiator or synergy factor genes tcdB2 and tccC3 from *Photorhabdus luminescens* strain W-14 were joined through a specific synthetic oligonucleotide segment. In a multi-step process, using standard molecular biology techniques, the 3' end of the coding region of the tcdB2 gene was modified to eliminate the native translation termination codon, and enable the joining of the tcdB2 coding region to other coding regions. Likewise the 5' end of the coding region of the tccC3 gene was engineered to allow joining to other coding regions. The two amended coding regions were then joined as a single open reading frame, in a pET expression plasmid vector (Novagen, Madison Wis.) in such a way as to maintain appropriate bacterial transcription and translation signals. The plasmid was designated pDAB8920. The DNA sequence of the resulting fused coding region cassette is shown in SEQ ID NO:1. The coding regions of TcdB2, the linker peptide and TccC3 are represented by nucleotides 48-4469, 4470-4511 and 4512-7394 of SEQ ID NO:1, respectively. The polypeptide encoded by the fused gene in SEQ ID NO:1 is shown in SEQ ID NO:2. The amino acid sequences of TcdB2, the linker peptide and TccC3 are represented by amino acids 1-1474, 1475-1488 and 1489-2448 of SEQ ID NO:2 respectively.

The joining oligonucleotide (SEQ ID NO:3) between the tcdB2 and tccC3 coding regions encodes a polypeptide linker fragment (SEQ ID NO:4). The linker polypeptide was specifically designed to contain several inventive features. The goal was to connect the TcdB2 and TccC3 protein domains through an unstructured, hydrophilic, flexible polypeptide linker. Such a linker is not expected to inhibit folding of the connected TcdB2 and TccC3 proteins. In addition, the linker region was constructed to be susceptible to proteolysis, thereby allowing separation of TcdB2 and TccC3 proteins.

Specifically, proline residues were engineered onto each end of the linker peptide connecting TcdB2 and TccC3 (SEQ ID NO:4). The proline residues were added with the intention of introducing bends into the polypeptide backbone, thereby exposing the residues between them. Unique restriction sites were inserted into the joining oligonucleotide sequence adjacent to the proline codons (SEQ ID NO:3). The Bam HI restriction site encodes the amino acids glycine and serine. Glycine is known to introduce flexibility within the polypeptide backbone and to inhibit secondary structures within the protein. The Stu I site encodes the proline described above and arginine. The amino acids serine and arginine are both hydrophilic residues. The unique restriction sites facilitate introduction of additional joining oligonucleotides.

The amino acid linker sequence encoded between the Bam HI and Stu I restrictions sites (DNKGQTIRT (SEQ ID NO: 83) of SEQ ID NO: 4) was chosen from the Toxin Complex protein TcdB1. This sequence was preferred because it had four desirable features. First, seven of the nine encoded amino acids are hydrophilic residues (aspartic acid (D), aparagine (N), lysine (K), gtutamine (Q), threonine (T) and arginine (R)). The hydrophilic residues ensure the segment is on the surface of the fission protein and exposed to polar solvents. Second, two sites predicted to be cleaved by the protease trypsin are contained within the sequence (KG and RT). Third, the segment contains residues known to inhibit secondary structure of proteins. (glycine and asparagine). Fourth, the sequence contains the residue glycine which is known to introduce flexibility into peptide chains.

EXAMPLE 2

Protein Sources for Bioassay

The Class A TC proteins TcdA and XptA2$_{xwi}$ were utilized in a purified form prepared from cultures of *Pseudomonas fluorescens* heterologously expressing the respective genes. The Class B and Class C potentiators, TcdB2 and TccC3 and the new fusion protein TcdB2/TccC3 V1 were tested as components of *E. coli* lysates. The use of lysates was validated by comparison to purified preparations of TcdB2 and TccC3. Reading frames encoding TcdB2 and TccC3 proteins were engineered for expression in *E. coli* by cloning into a pET plasmid (Novagen, Madison Wis.) a dicistronic operon of the order tcdB2-tccC3. The plasmid which encoded and produced the separate (non fused) TcdB2 and TccC3 proteins was named pDAB3093. Each coding region contained an appropriately spaced ribosome binding site (relative to the start codon) and termination signal. The DNA sequences at the 5' ends of the genes were modified to reduce predicted secondary structure of the RNA and hence increase translation. These base changes were silent and did not result in amino acid changes in the encoded protein.

EXAMPLE 3

Expression Conditions and Lysate Preparations

The expression plasmids pET (empty vector control), pDAB3093 and pDAB8920 were transformed into the *E. coli* T7 expression strain BL21(DE3) (Novagen, Madison Wis.) using standard methods. Expression cultures were initiated with 10-200 freshly transformed colonies into 250 mL LB medium containing 50 µg/ml antibiotic and 75 µM IPTG (isopropyl-β-D-thiogalatopyranoside). The cultures were grown at 28° C. for 24 hours at 180-200 rpm. The cells were collected by centrifugation in 250 ml Nalgene bottles at 3,400×g for 10 minutes at 4° C. The pellets were suspended in 4-4.5 mL Butterfield's Phosphate solution (Hardy Diagnostics, Santa Maria, Calif.; 0.3 mM potassium phosphate pH 7.2). The suspended cells were transferred to 50 mL polypropylene screw cap centrifuge tubes with 1 mL of 0.1 mm diameter glass beads (Biospec, Bartlesville, Okla., catalog number 1107901). The cell-glass bead mixture was chilled on ice, then the cells were lysed by sonication with two 45 second bursts using a 2 mm probe with a Branson Sonifier 250 (Danbury CT) at an output of ~20, chilling completely between bursts. The lysates were transferred to 2 mL Eppendorf tubes and centrifuged 5 minutes at 16,000×g. The supernatants were collected and the protein concentration measured. Bio-Rad Protein Dye Assay Reagent was diluted 1:5 with H$_2$O and 1 mL was added to 10 µL of a 1:10 dilution of each sample and to bovine serum albumin (BSA) at concentrations of 5, 10, 15, 20 and 25 µg/mL. The samples were then read on a spectrophotometer measuring the optical density at the wavelength of 595 nm in the Shimadzu UV160U spectrophotometer (Kyoto, JP). The amount of protein contained in each sample was then calculated against the BSA standard curve and adjusted to between 3-6 mg/mL with phosphate buffer. The lysates were typically assayed fresh, however no loss in activity was observed when stored at −70° C.

EXAMPLE 4

Bioassay Conditions

Insect bioassays were conducted with neonate larvae on artificial diets in 128-well trays specifically designed for insect bioassays (C-D International, Pitman, N.J.). The species assayed were the southern corn rootworm, *Diabrotica undecimpunctata howardii* (Barber), the corn earworm, *Helicoverpa zea* (Boddie), and the beet armyworm, *Spodoptera exigua* (Hübner).

Bioassays were incubated under controlled environmental conditions (28° C., ~40% r.h., 16:8 [L:D]) for 5 days at which point the total number of insects in the treatment, the number of dead insects, and the weight of surviving insects were recorded.

The biological activity of the crude lysates alone or with added TcdA or XptA2$_{xwi}$ toxin proteins was assayed as follows. Crude *E. coli* lysates (40 µL) of either control cultures or those expressing potentiator proteins were applied to the surface of artificial diet in 8 wells of a bioassay tray. The average surface area of treated diet in each well was ~1.5 cm² The lysates were adjusted to between 3-5 mg/mL total protein and were applied with and without TcdA or XptA2$_{xwi}$. The TcdA or XptA2$_{xwi}$ added were highly purified fractions from bacterial cultures heterologously expressing the proteins. The final concentrations of XptA2$_{xwi}$ and TcdA on the diet were 250 ng/cm² and 50 ng/cm², respectively.

EXAMPLE 5

Bioassay Results

Table 5 shows the bioassay results for lysates of cells programmed to express the fusion protein TcdB2/TccC3 V1, as compared to control cell lysates and lysates of cells programmed to express the non fused potentiators TcdB2+ TccC3. Examination of the data show that TcdA (coleopteran toxin) and XptA2$_{xwi}$ (lepidopteran toxin) had negligible impact when mixed with control lysates. It should be noted that the amount of TcdA and XptA2$_{xwi}$ added to the lysates was adjusted to highlight the potentiation affect of the TcdB2 and TccC3 encoding genes. Lysates from pDAB3093-containing cells alone did not kill insects. However, when mixed with TcdA or XptA2$_{xwi}$, significant mortality was noted with the expected spectrum. Surprisingly, lysates of cells programmed to produce the fusion protein TcdB2/TccC3 V1 exhibited a similar activity profile as the non fused potentiators. Analysis of the various lysates by SDS-PAGE showed the presence of a prominent ~280 kDa in pDAB8920 samples. The migration of the band is consistent with the predicted molecular weight of TcdB2/TccC3 V1. The band was not detected in control or pDAB3093 samples. These results demonstrate that the plasmid pDAB8920 produces the novel fusion protein TcdB2/TccC3 V1 and this protein potentiates the activity of the insect toxins TcdA and XptA2.

TABLE 5

Response of coleopteran and lepidopteran species to *E. coli* lysates and purified proteins. Seven to nine insects used per replicate. Data are for three independent replicates.

| | | Insect Species | | |
|---|---|---|---|---|
| Sample | Lysates Tested | Southern Corn Rootworm | Corn Earworm | Beet Armyworm |
| pET | Control | 0 | 0 | 0 |
| pET + TcdA | Control | 0 | 0 | 0 |
| pET + XptA2 | Control | 0 | 0 | 0 |
| pDAB3093 | TcdB2 + TccC3 | 0 | 0 | 0 |
| pDAB3093 + TcdA | TcdB2 + TccC3 | ++++ | 0 | 0 |
| pDAB3093 + XptA2 | TcdB2 + TccC3 | 0 | ++++ | ++++ |
| pDAB8920 | TcdB2/Tcc3 V1 | 0 | 0 | 0 |
| pDAB8920 + TcdA | TcdB2/Tcc3 V1 | ++++ | + | + |
| pDAB8920 + XptA2 | TcdB2/TccC3 V1 | 0 | ++++ | ++++ |

Mortality Scale:
0 = 0-20%;
+ = 21-41%;
++ = 41 = 60%;
+++ = 61-80%;
++++ = 81-100%.

EXAMPLE 6

Binding of TcdB2+TccC3 and TcdB2/TccC3 V1 to XptA2

Purified samples of heterologously expressed TcdB2+ TccC3 complex and the TcdB2/TccC3 V1 fusion protein were prepared. Binding of the TcdB2+TccC3 complex (non fused) and the TcdB2/TccC3 V1 fusion protein to XptA2 was measured by surface plasmon resonance (SPR) spectroscopy using a BiaCore 3000 instrument. Briefly, highly purified (0.05 mg/ml) XptA2 in 10 mM sodium acetate, pH 4.8 was coupled to a CM4 chip having been activated with N-hydroxysuccinimide and N-ethyl-N'-(dimethylaminopropyl) carbodiimide to achieve 2,000 resonance units (RU) of immobilization. After the immobilization, the remaining active amine groups were blocked with 1 M ethanolamine hydrochloride, pH 8.5. Binding was measured by flowing 200 µl of either 100 nM of TcdB2+TccC3 complex or 25 nM TcdB2/TccC3 V1 fusion protein in 10 mM HEPES pH 7.4, 150 mM NaCl, and 0.005% Surfactant P20 at a flow rate of 30 µl/min over the chip containing the immobilized XptA2 protein. Changes in RU were measured and the rate of change fitted to a non-linear regression curve to obtain the rate of association of TcdB2+ TccC3 complex or TcdB2/TccC3 V1 fusion protein to the XptA2. Surprisingly, the association rate of the TcdB2/ TccC3 V1 fusion protein (ka=1.03×10$^6$) was at least 20-fold greater than the association rate of TcdB2+TccC3 complex (ka=4.49×10$^4$). That is, the TcdB2/TccC3 V1 fusion protein bound XptA2 faster than the non fused TcdB2+TccC3 complex. Once bound, neither preparation dissociated readily from XptA2.

EXAMPLE 7

Additonal TcdB2/TccC3 Fusion Proteins

Additional fusion genes between the TcdB2 and TccC3 coding regions were constructed using standard molecular biology techniques. All constructions were made in the pET expression plasmid described in Example 1 and had appropriate bacterial transcription and translation signals. A total of six different TcdB2/TccC3 fusions were made and tested. Table 6 shows the TcdB2/Linker/TccC3 protein junction sequence for the fusion proteins. For clarity, the fusion proteins will be referred to by a numerical designation derived from the encoding plasmid. For example, fusion protein TcdB2/TccC3 V1 as described in Example 1, encoded by plasmid pDAB8920, will be known as protein 8920 (Table 6). With the exception of a single fusion protein (8563) all of the fusion proteins contain full length coding regions for TcdB2 and TccC3. Protein 8563 contains a truncated form of the TccC3 coding region where the DNA encoding the first 21 amino acids has been deleted. The linker regions between the TcdB2 and TccC3 coding regions vary in length encoding from zero to 93 amino acids. Table 6 lists the fusion protein expression plasmids, gene and protein names, coding regions, relevant protein segments and associated SEQ ID NOs. Table 7 lists the junctions including the linker segments of the fusion proteins described in Table 6. A brief description of the various fusion proteins is given below.

TABLE 6

Fusion Protein Sequence Information

| Plasmid | Gene Name | DNA SEQ ID NO: | Coding Region (excluding stop codons; nucleotides) | Encoded Fusion Protein | Protein SEQ ID NO: | TcdB2 Segment (AA residues) | Linker Segments (AA residues) | TccC3 Segment (AA residues) | XptA2 Segment (AA residues) |
|---|---|---|---|---|---|---|---|---|---|
| pDAB8563 | 8563 | 45 | 48-7295 | 8563 | 46 | 1-1474 | 1475-1477 | 1478-2416 | NA |
| pDAB8564 | 8564 | 47 | 48-7349 | 8564 | 48 | 1-1474 | None | 1475-2434 | NA |
| pDAB8940 | 8940 | 49 | 48-7364 | 8940 | 50 | 1-1474 | 1475-1479 | 1480-2439 | NA |
| pDAB8920 | 8920 | 51 | 48-7391 | 8920 | 52 | 1-1474 | 1475-1488 | 1489-2448 | NA |
| pDAB8921 | 8921 | 53 | 48-7463 | 8921 | 54 | 1-1474 | 1475-1512 | 1513-2472 | NA |
| pDAB8923 | 8923 | 55 | 48-7628 | 8923 | 56 | 1-1474 | 1475-1567 | 1568-2527 | NA |
| pDAB8951 | 8951 | 57 | 21-7436 | 8951 | 58 | 999-2472 | 961-998 | 1-960 | NA |
| pDAB8811 | 8811 | 59 | 34-15018 | 8811 | 60 | 2548-4021 | XptA2/TcdB2 2539-2547 TcdB2/TccC3 4022-4035 | 4036-4995 | 1-2538 |

TABLE 7

Sequence of Fusion Protein Junctions

| Protein | Linker Size (AA) | | Linkers (underlined) and adjacent protein sequences of various toxin complex fusion proteins. |
|---|---|---|---|
| 8563 | 3; 21 AA TccC3 deletion | TcdB2 | >DENDTAAEVKKVKM> (SEQ ID NO:69) |
| | | Linker | >PGS> (SEQ ID NO:70) |
| | | TccC3 | >GLIIRNIDF> (SEQ ID NO:71) |
| 8564 | 0 | TcdB2 | >DENDTAAEVKKVKM> (SEQ ID NO:69) |
| | | Linker | None |
| | | TccC3 | >MKNIDPKLYQKTPTVSVYDNRGLIIRNIDF> (SEQ ID NO:72) |
| 8940 | 5 | TcdB2 | >DENDTAAEVKKVKM> (SEQ ID NO:69) |
| | | Linker | >PGSRP> (SEQ ID NO:73) |
| | | TccC3 | >MKNIDPKLYQKTPTVSVYDNRGLIIRNIDF> (SEQ ID NO:72) |
| 8920 | 14 | TcdB2 | >DENDTAAEVKKVKM> (SEQ ID NO:69) |
| | | Linker | >PGSDNKGQTIRTRP> (SEQ ID NO:4) |
| | | TccC3 | >MKNIDPKLYQKTPTVSVYDNRGLIIRNIDF> (SEQ ID NO:72) |
| 8921 | 38 | TcdB2 | >DENDTAAEVKKVKM> (SEQ ID NO:69) |
| | | Linker | >PRLDRAADITTQNAHDSAIVALRQNIPTPAPLSLRSRP> (SEQ ID NO:74) |
| | | TccC3 | >MKNIDPKLYQKTPTVSVYDNRGLIIRNIDF> (SEQ ID NO:72) |

TABLE 7-continued

Sequence of Fusion Protein Junctions

| Protein | Linker Size (AA) | Linkers (underlined) and adjacent protein sequences of various toxin complex fusion proteins. | |
|---|---|---|---|
| 8923 | 93 | TcdB2 | >DENDTAAEVKKVKM> (SEQ ID NO:69) |
| | | Linker | >PGSEAYADTHVYDPIGREIKVITAKGWFRRTLFTPWFTVNEDENDTA> (SEQ ID NO:75) |
| | | Linker | >AEVKKVKMPRLDRAADITTQNAHDSAIVALRQNIPTPAPLSLRSRP> (SEQ ID NO:76) |
| | | TccC3 | >MKNIDPKLYQKTPTVSVYDNRGLIIRNIDF> (SEQ ID NO:72) |
| 8951 | 38 | TccC3 | >DAEISFLTTIPLKNVKPHKR> (SEQ ID NO:77) |
| | | Linker | >PRLDRAADITTQNAHDSAIVALRQNIPTPAPLSLRSRP> (SEQ ID NO:74) |
| | | TcdB2 | >MQNSQDFSITELSLPKGGGA> (SEQ ID NO:78) |
| 8811 | 9 | XptA2 | >KALLESLSDIILHIRYTIRS> (SEQ ID NO:79) |
| | | Linker | >PRDRTRPTS> (SEQ ID NO:80) |
| | | TcdB2 | >MQNSQDFSITELSLPKGGGA> (SEQ ID NO:78) |
| 8811 | 14 | TcdB2 | >WFTVNEDENDTAAEVKKVKM> (SEQ ID NO:81) |
| | | Linker | >PGSDNKGQTIRTRP> (SEQ ID NO:4) |
| | | TccC3 | >MKNIDPKLYQKTPTVSVYDN> (SEQ ID NO:82) |

Plasmid pDAB8563 encodes fusion protein 8563 which consists of the entire TcdB2 coding region fused through a three amino acid linker (PGS) to a truncated TccC3 coding region (TccC3 amino acids 1-21 deleted). The DNA sequence for the gene encoding protein 8563 is shown in SEQ ID NO:45. The amino acid sequence for protein 8563 is shown in SEQ ID No:46

Plasmid pDAB8564 encodes fusion protein 8564 which consists for the entire TcdB2 coding region fused directly to the entire coding region of TccC3. There are no additional amino acids which constitute a linker sequence. The DNA sequence for the gene encoding protein 8564 is shown in SEQ ID NO:47. The amino acid sequence for protein 8564 is shown in SEQ ID NO:48.

Plasmid pDAB8940 encodes fusion protein 8940 which consists for the entire TcdB2 coding region fused directly to the entire coding region of TccC3 through a five amino acid linker. The DNA sequence for the gene encoding protein 8940 is shown in SEQ ID NO:49. The amino acid sequence for protein 8940 is shown in SEQ ID NO:50.

Plasmid pDAB8920 encodes fusion protein 8920 which consists for the entire TcdB2 coding region fused directly to the entire coding region of TccC3 through a fourteen amino acid linker. A portion of the linker sequence (DNKGQTIRT) (SEQ ID NO:83) was derived from the *Photorhabdus* protein TcdB1 as described in Example 1. The DNA sequence for the gene encoding protein 8920 is shown in SEQ ID NO:51. The amino acid sequence for protein 8920 is shown in SEQ ID NO:52.

Plasmid pDAB8921 encodes fusion protein 8921 which consists for the entire TcdB2 coding region fused directly to the entire coding region of TccC3 through a 38 amino acid linker. Thirty six amino acids of the linker sequence (PRLDRAADITTQNAHDSAIVALRQNIPTPAPL SLRS) (SEQ ID NO:84) are derived from the *Photorhabdus* protein TcdA1. The DNA sequence for the gene encoding protein 8921 is shown in SEQ ID NO:53. The amino acid sequence for protein 8921 is shown in SEQ ID NO:54.

Plasmid pDAB8923 encodes fusion protein 8923 which consists for the entire TcdB2 coding region fused directly to the entire coding region of TccC3 through a 93 amino acid linker. There are three segments to the linker. The first segment, immediately following the coding region of TcdB2 is a three amino acid segment (PGS) (SEQ ID NO:70). The second segment is a duplication of the final 52 amino acids of TcdB2 (EAYADTHVYDPIGREIKVITAKGWFRRT LFTPWFTVNEDENDTAAEVKKVKM) (SEQ ID NO:85). The third segment is the 38 amino acid linker described for protein 8921 above (SEQ ID NO:74). The DNA sequence for the gene encoding protein 8923 is shown in SEQ ID NO:55. The amino acid sequence for protein 8923 is shown in SEQ ID NO:56.

Expression conditions and lysate preparation were as described in Examples 3 and 4. Analysis of the fusion protein lysates by SDS-PAGE 4-20% tris-glycine (Cambrex, Walkersville Md.) showed a prominent Coomassie blue staining band within the expected molecular weight range (~270-285 kDa), these high molecular weight bands were not present in control lysates. The lysates were bioassayed as above with a slight modification, lysates were assayed with XptA2 adjusted to either 67 or 133 ng/$cm^2$. The results from these bioassays are expressed as growth inhibition. Percent growth inhibition is calculated as follows: Growth Inhibtion (%)=100×(avg. weight of insects in treatment)/(avg. weight of insects in control).

TABLE 8

Growth of corn earworm fed *E. coli* lysates alone and with purified XptA2 protein. Bioassays were repeated 2-3 times using 8 insects/treatment in each replicate.

| Sample | Lysate Tested | \multicolumn{3}{c}{XptA2 Concentration (ng/cm$^2$)} | | |
|---|---|---|---|---|
| | | 0 | 67 | 133 |
| pET | Control | 0 | 0 | 0 |
| PDAB3093 | TcdB2 + TccC3 | 0 | ++++ | ++++ |
| PDAB8563 | 8563 | 0 | + | ++ |
| PDAB8564 | 8564 | 0 | ++++ | ++++ |
| PDAB8940 | 8940 | 0 | ++++ | ++++ |
| PDAB8920 | 8920 | 0 | ++++ | ++++ |
| PDAB8921 | 8921 | 0 | ++++ | ++++ |
| PDAB8923 | 8923 | 0 | ++++ | ++++ |

Growth Inhibition Scale:
0 = 0-20%;
+ = 21-40%;
++ = 41-60%;
+++ = 61-80%;
++++ = 81-100%.

The bioassay results shown in Table 8 show that the TcdB2/TccC3 fusion proteins have high potentiation activity when combined with XptA2. Fusion protein lysates 8764 (0 aa linker), 8940 (5 aa linker), 8920 (14 aa linker) 8921 (38 aa linker) and 8923 (93 aa linker) are qualitatively equivalent to the 3093 lysate consisting of non fused TcdB2+TccC3. The lysate of 8963 (3 aa linker 21 aa deletion of TccC3), while demonstrating substantial potentiation activity, appears to be less potent than the other lysates.

These data clearly demonstrate that Toxin Complex fusion proteins consisting of both a B class and C class potentiator may be fused to create novel fusion proteins. The fusion proteins potentiate Class A protein anti-insect activity. The fusions may consist of deletions of the full length protein or may be full length proteins fused directly or through linkers up to 93 amino acids.

EXAMPLE 9

Construction and testing of Fusion protein 8951 TccC3/TcdB2

Examples 1-8 describe and document the construction and testing of a variety of toxin complex fusion protein genes. The fusion proteins encoded by these genes consist of an amino to carboxy terminal order of TcdB2/TccC3, joined by a variety of linkages. In this example, the construction of another toxin complex fusion protein gene is described. This new construction encodes a fusion protein with an inverted order, that is, an amino to carboxy terminal order of TccC3/TcdB2.

The genetic construction of the TccC3/TcdB2 encoding reading frame was a multi step process. In the first step, the tccC3 gene was modified by the addition of a synthetic DNA segment at the 3' end of the tccC3 gene. The synthetic fragment encoded the linker sequence and provided unique restriction sites to allow joining of the TcdB2 coding region in a second step. In a third step, the newly constructed fusion protein encoding gene was transferred to a pET expression plasmid as described in Example 1. The resulting expression plasmid is called pDAB8951, the gene encoding the fusion protein is called 8951 and is shown in SEQ ID NO:57. The encoded fusion protein consisting of TccC3 fused to TcdB2 through a thirty eight amino acid linker is called 8951 and is shown in SEQ ID NO:58. The TccC3, linker and TcdB2 amino acid segments are described in Table 6. The junction between TccC3, linker and TcdB2 is shown in Table 7.

EXAMPLE 10

Expression and Bioassay of Fusion Protein 8951

The expression, lysate preparation and bioassay of fusion protein 8951 were as described in Example 8. Also as described in Example 8, SDS-PAGE analysis showed a Coomassie blue staining band corresponding the expected molecular weight of the fusion protein. Bioassay results for two *E. Coli* clones expressing fusion protein 8951 are shown in Table 9.

TABLE 9

| Growth of corn earworm fed *E. coli* lysates alone and with purified XptA2 protein. Bioassays were repeated twice for each of the clones tested using 8 insects/treatment in each replicate. | | | | |
|---|---|---|---|---|
| | | XptA2 Concentration (ng/cm$^2$) | | |
| Sample | Lysate Tested | 0 | 200 | 400 |
| pET | Control | 0 | 0 | 0 |
| pDAB8951-1 | 8951 clone 1 | 0 | ++++ | ++++ |
| pDAB8951-2 | 8951 clone 2 | 0 | ++++ | ++++ |

Growth Inhibition Scale:
0 = 0-20%;
+ = 21-40%;
++ = 41-60%;
+++ = 61-80%;
++++ = 81-100%.

EXAMPLE 11

Construction of the Gene Encoding the Triple Fusion Protein 8811 (XptA2/TcdB2/TccC3)

The examples which follow relate to the construction and testing of a translational fusion between three coding regions. The coding region of the *Xenorhabdus* protein XptA2 (a Class A protein) was fused to the coding regions *Photorhabdus* TcdB2 (a Class B protein) and TccC3 (a Class C protein) via the 8920 double fusion (tcdB2/tccC3) to create the triple fusion gene xptA2/tcdB2/tccC3. This novel triple fused gene is called 8811 (SEQ ID NO:59) and encodes polypeptide 8811 (SEQ ID NO:60). Lysates containing the 8811 fusion protein demonstrated excellent functional activity. This invention reduces by two thirds the number of transcriptional control sequences required for expression in plants and other organisms and eliminates the disadvantages that accompany transformation of separate, complete genes. This invention also provides a mechanism for maintaining physical and temporal synchrony of translation for interacting proteins, particularly in eukaryotic cells.

The 3' end of the coding region of the Toxin Complex Toxin XptA2 was modified in a multi step process, using standard molecular biology techniques. Likewise, the 5' end of the 8920 coding region was modified. The two modified coding regions were joined by a synthetic nucleotide linker to create a single open reading frame. The fused gene consisting of the coding regions for XptA2, TcdB2 and TccC3, was engineered into an *E. coli* expression plasmid under control of a modified lac promoter. The construction was done in such a way as to maintain appropriate bacterial transcription and translation signals. The plasmid was designated pDAB8811. The DNA sequence of the fused coding region cassette is shown in SEQ ID NO:59. The cassette is 15,036 nucleotides in length and contains coding regions for XptA2 (nts 34-7647), the XptA2/TcdB2 linker peptide (nts 7648-7674), TcdB2 (nts 7675-12096), the TcdB2/TccC3 linker peptide (nts 12097-12138) and TccC3 (nts 12139-15018). The polypeptide encoded by the fused gene in SEQ ID NO:59 is shown in SEQ ID NO:60. The fusion protein is predicted to contain 4,995 amino acids with segments representing XptA2 (residues 1-2538), the XptA2/TcdB2 linker peptide (residues 2539-2547), TcdB2 (residues 2548-4021), the TcdB2/TccC3 linker peptide (residues 4022-4035) and TccC3 (residues 4036-4995). A summary of the DNA and protein segments of the triple fusion is presented in Table 6. The amino acid sequences of the two linkers (XptA2/TcdB2 and TcdB2/TccC3) are shown in Table 7.

EXAMPLE 12

Expression Conditions of pDAB8811 and Lysate Preparations

The expression plasmids pBT (empty vector control described in U.S. application Ser. No. 10/754,115, filed Jan. 7, 2003), pDAB8812 (contains the XptA2 only encoding region) and pDAB8811 (contains the 8811 coding region) were transformed into the *E. coli* expression strain BL21 (Novagen, Madison Wis.) using standard methods. Expression cultures were initiated with 10-200 freshly transformed colonies into 200 mL LB medium containing 50 µg/ml antibiotic and 75 µM IPTG (isopropyl-α-D-thiogalatopyranoside). The cultures were grown at 28° C. for 24 hours at 180-200 rpm. The cells were collected by centrifugation in 250 ml Nalgene bottles at 3,400×g for 10 minutes at 4° C. The pellets were suspended in 4-4.5 mL Butterfield's Phosphate solution (Hardy Diagnostics, Santa Maria, Calif.; 0.3 mM potassium phosphate pH 7.2). The suspended cells were transferred to 50 mL polypropylene screw cap centrifuge tubes with 1 mL of 0.1 mm diameter glass beads (Biospec, Bartlesville, Okla., catalog number 1107901). The cell-glass bead mixture was chilled on ice, then the cells were lysed by sonication with two 45 second bursts using a 2 mm probe with a Branson Sonifier 250 (Danbury Conn.) at an output of ~30, chilling completely between bursts. The lysates were transferred to 2 mL Eppendorf tubes and centrifuged 5 minutes at 16,000×g. Analysis of the lysates by SDS-PAGE as described above showed a Coomassie blue staining band of greater than 500 kDa present in 8811 lysates corresponding to the triple fusion 8811 protein which was not present in controls or XptA2 lysates. The supernatants were collected and submitted for bioassay.

EXAMPLE 13

Bioassay Conditions for Triple Fusion 8811 Lysates

Insect bioassays were conducted with neonate larvae on artificial diets in 128-well trays specifically designed for insect bioassays (C-D International, Pitman, N.J.). The species assayed was corn earworm, *Helicoverpa zea* (Boddie). Bioassays were incubated under controlled environmental conditions (28° C., ~40% r.h., 16:8 [L:D]) for 5 days at which point the total number of insects in the treatment, the number of dead insects, and the weight of surviving insects were recorded. The biological activity of the crude lysates was assayed as follows. Crude *E. coli* lysates (40 µL) of either control cultures or those expressing the triple fusion protein 8811 were applied to the surface of artificial diet in 8 wells of a bioassay tray. The average surface area of treated diet in each well was ~1.5 cm².

EXAMPLE 14

Bioassay Results for Triple Fusion 8811 Lysates

Table 10 shows the bioassay results for lysates of cells programmed to express the protein XptA2 alone or the fusion protein 8811, as compared to control lysates (empty vector). The data show that lysates prepared from cells programmed to express the triple fusion 8811 severely limited the growth of the insects. The control lysates, either the empty vector or XptA2 alone, had little effect on insect growth. These data clearly demonstrate that the lysates programmed to express the triple fusion protein 8811 are much more effective than lysates programmed to express the XptA2 protein alone.

TABLE 10

Response of corn earworm (*Helicoverpa zea* (Boddie)) to *E. coli* lysates expressing Toxin Complex proteins.

| Sample | Lysate Tested | Growth Inhibition Corn Earworm |
|---|---|---|
| pBT280 | Empty vector control | 0 |
| pDAB8812 | XptA2 | 0 |
| pDAB8811 clone 1 | 8811 | ++++ |
| pDAB8811 clone 2 | 8811 | ++++ |
| pDAB8811 clone 3 | 8811 | ++++ |
| pDAB8811 clone 4 | 8811 | ++++ |

Two independent expression culture lysates were tested for each sample.
Eight insects used per test.
Growth Inhibition Scale:
0 = 0-20%;
+ = 21-40%;
++ = 41-60%;
+++ = 61-80%;
++++ = 81-100%.

EXAMPLE 15

Binding of TcdB2/TccC3 Fusion Proteins to Immobilized XptA2

To determine the relative affinity of the various TcdB2/TccC3 fusion proteins to interact with the XptA2 protein, XptA2 was immobilized onto a CM5 chip using standard amine coupling techniques as described above. Binding was determined by measuring surface plasmon resonance (SPR) on a Biacore 3000 SPR spectrometer, and the level of binding was measured in resonance units (RU). Approximately 5,000 RU of XptA2 was immobilized on the chip. Lysates were prepared from *E. coli* cultures programmed to express the fusion proteins 8920, 8921, 8923 and 8940. The lysates were diluted 1:10 and were flowed over the immobilized XptA2 protein at a rate of 30 microliters/min for 200 seconds. At that time, flowing of the cell lysate was stopped, and buffer solution only was flowed over the XptA2 protein. The switch from cell lysate to buffer only allowed the bound TcdB2/TccC3 fusion proteins to dissociate from XptA2. Dissociation was measured 200 seconds after switching from cell lysate to buffer only, and was expressed as the difference between the RU measured immediately after 200 seconds of cell lysate flowing and the RU measured after 200 seconds of flowing only the buffer solution. Results from these experiments are shown in Table 11. All four soluble lysates containing the TcdB2/TccC3 fusions protein bound to the immobilized XptA2 strongly, between 733-836 RU. Very little dissociation occurred after binding (17.9-21.4 RU).

TABLE 11

| Analyte | Binding after 200 sec. (RU) | Dissociation after 200 sec. (RU) |
| --- | --- | --- |
| pET lysate (control) | 23.6 | 14.1 |
| 8940 (5 aa linker) | 830.6 | 17.9 |
| 8920 (14 aa linker) | 836.4 | 19.0 |
| 8921 (38 aa linker) | 764.9 | 18.8 |
| 8923 (93 aa linker) | 733.0 | 21.4 |

EXAMPLE 16

Comparative Non-Fused and Fused Activity and Binding Studies of the Purified TcdB2/TccC3 Fusion Protein 8920

In an effort to more fully characterize the activity the TcdB2/TccC3 fusion protein (referred to herein as the 8920 protein) as compared to a non-fused TcdB2+TccC3 protein complex, the fusion proteins or complexes were purified from bacterial cultures programmed to express these proteins heterologously. The purified samples were then bioassayed with added Class A proteins (XptA2 or TcdA). In addition, the ability of these two samples to bind immobilized XptA2 was measured by Surface Plasmon Resonance.

Purification. A two liter culture of recombinant *E. coli* cells producing either the 8920 fusion protein or the TcdB2+TccC3 complex was grown overnight, the cells were centrifuged, and the cell pellet was frozen at −80° C. for storage. The cell pellet was rapidly defrosted under cold water and suspended in 250 mL of 50 mM Tris-HCl pH 8.0, 0.10 M NaCl, 1 mM DTT, 10% glycerol and lysozyme (0.6 mg/mL). A small amount of glass beads (0.5 mm, Biospec, Bartlesville, Okla., catalog number 1107901) was added and the solution gently shaken to facilitate suspension. The cells were then disrupted in approximately 50 mL batches by sonication at maximum output power (Branson Sonifier Model 250 with a microprobe) two times for 30 seconds, keeping the lysate cold using an ice bath. The broken cells were then centrifuged at 48,000×g for 60 min at 4° C. The supernatant was collected and 4.0 mL of a general protease inhibitor from Sigma Chemical Company (St. Louis, Mo.; Catalog No. P2714) were added. The solution was diluted 2-fold with cold distilled water, then loaded onto a Q Sepharose XL anion exchange column (1.6 cm×10 cm). Bound proteins were first washed with 250 mL of 25 mM Tris-HCl, pH 8.0,+50 mM NaCl, and then eluted with 50 mM Tris HCl pH 8.0+300 mM NaCl (250 mL). The eluted protein solution was dialyzed overnight against 25 mM Tris-HCl, pH 8.0 and then loaded onto a Mono Q 10/10 anion exchange column (1 cm×10 cm). The protein was eluted with a gradient of 0 to 500 mM NaCl in 25 mM Tris-HCl, pH 8.0 in 15 column volumes at 2 mL/min, taking 3 mL fractions. Fractions containing the 8920 fusion protein (or the TcdB2+TccC3 complex) eluted at about 120 mM NaCl. These fractions were combined, diluted, and re-loaded onto the Mono Q 10/10 column and eluted with a shallow gradient of 0 to 300 mM NaCl in 25 mM Tris-HCl, pH 8.0 as before, but taking 2 mL fractions. Fractions containing the 8920 fusion protein (or the TcdB2+TccC3 complex) were combined and concentrated to approximately 1.0 mL, and loaded onto a Superose 200 size exclusion column (1.6 cm×60 cm), equilibrated in 50 mM Tris-HCl, pH 8.0, with 100 mM NaCl, 5% glycerol, 0.05% Tween-20. Proteins were eluted at a flow rate of 1.0 mL/min. Fractions corresponding to either the 8920 fusion protein or the TcdB2+TccC3 complex were combined and analyzed by SDS-PAGE to confirm their identity and purity.

Insect Bioassays. Corn earworm (CEW, *Helicoverpa zea*) used in these studies were supplied as eggs by the insectary at North Carolina State University (Raleigh, N.C.). Southern corn rootworm eggs (SCR, *Diabrotica undecimpunctata howardi*) were supplied by FrenchAg Research, Lamberton, Minn., or Crop Characteristics, Inc., Farmington, Minn. The eggs were washed and held at 24° C. and 50% RH until they hatched. The artificial diet consisted of 2-4% powdery solids such as soy flour, yeast, wheat germ, casein, sugar, vitamins, and cholesterol suspended in a 1.0-2.0% dissolved agar in water matrix. For bioassay, proteins or protein complexes were diluted in 3- or 4-fold increments into 10 mM sodium phosphate buffer, pH 7.0 to concentrations ranging from 500 to 0.48 ng protein per cm$^2$, then applied to the surface of the artificial diet. Each concentration was assayed separately in 8 replications by placing newly emerged neonates onto the treated diet and holding the test at 28° C. for five days. In some of the tests, the weights of the larvae were measured at the end of the time period, in addition to recording mortality or stunting of the insects. Dead larvae were scored as zero weight.

Binding Assays. Binding of TcdB2+TccC3 and the 8920 fusion protein to XptA2 was measured by surface plasmon resonance (SPR) spectroscopy using a BiaCore 3000 instrument. Briefly, highly purified (0.05 mg/mL) XptA2 in 10 mM sodium acetate, pH 4.8 was coupled to a CM4 chip previously activated with N-hydroxysuccinimide and N-ethyl-N'-(dimethylaminopropyl)carbodiimide (as per the manufacturer's instructions) to achieve 2,000 resonance units (RU) of immobilization. After XptA2 immobilization, the remaining active amine groups were blocked with 1 M ethanolamine hydrochloride, pH 8.5. Binding to XptA2 was measured by flowing 200 μL of 100 nM of TcdB2+TccC3 or 25 nM 8920 fusion protein (in 10 mM HEPES pH 7.4, 150 mM NaCl, and 0.005% Surfactant P20) over the chip at a flow rate of 30 μL/min. Changes in RU were measured, and the rate of change fitted to a non-linear regression curve to obtain the rate of association of TcdB2+TccC3 or 8920 fusion protein to the XptA2.

Bioassay Results. The increased effectiveness of the 8920 fusion protein to potentiate the Class A protein XptA2 against CEW larvae, as compared to the TcdB2+TccC3 complex, is shown in Table 12, Panels A and B. In these experiments, the concentration of XptA2 was held constant at 250 ng/cm$^2$. In Panel A, the killing/stunting activity of the XptA2+TcdB2+TccC3 complex is shown. The data demonstrate that killing/stunting activity dramatically decreases at concentrations of TcdB2+TccC3 below 7.8 ng/cm². In contrast, Panel B shows the more potent killing/stunting activity of the XptA2+8920 TcdB/TccC3 fusion protein complex. In this case, the XptA2+8920 combination is effective in causing stunting of all the test larvae at 1.9 ng/cm² of the 8920 fusion protein. Surprisingly, these data demonstrate that the 8920 fusion protein is at least 4× as effective as the non-fused parental proteins TcdB2+TccC3.

TABLE 12

Demonstration of the insect activity of XptA2 (250 ng/cm²) in the presence of increasing concentrations of either purified TcdB2 + TccC3 complex (Panel A) or the TcdB2/TccC3 fusion protein 8920 (Panel B).

| Panel A | | | | Panel B | | | |
|---|---|---|---|---|---|---|---|
| Concentration of TcdB2 + TccC3 (ng/cm²) | Corn Earworm Larvae | | | Concentration of 8920 Fusion (ng/cm²) | Corn Earworm Larvae | | |
| | Dead | Stunted | Total | | Dead | Stunted | Total |
| 500 | 8 | 0 | 8 | 500 | 8 | 0 | 8 |
| 125 | 6 | 2 | 8 | 125 | 6 | 2 | 8 |
| 31.2 | 0 | 8 | 8 | 31.2 | 0 | 8 | 8 |
| 7.8 | 1 | 7 | 8 | 7.8 | 0 | 8 | 8 |
| 1.9 | 0 | 2 | 8 | 1.9 | 0 | 8 | 8 |
| 0.48 | 0 | 1 | 8 | 0.48 | 0 | 0 | 8 |

Additional bioassays against SCR and CEW larvae were performed using various concentrations of the 8920 fusion protein added to 500 ng/cm² of either TcdA (tested against SCR), or XptA2 (tested against CEW). The results are shown in Table 13. These data clearly demonstrate that even low concentrations of the 8920 fusion protein are very effective at potentiating 500 ng/cm² of either TcdA or XptA2.

TABLE 13

Demonstration of the effectiveness of the TcdB2/TccC3 fusion protein 8920 to potentiate both TcdA (assayed against southern corn rootworm) and XptA2 (assayed against corn earworm). Various concentrations of 8920 were added to 500 ng/cm² of either TcdA or XptA2. Total weights of the 8 insect larvae are shown.

| Concentration of 8920 Fusion (ng/cm²) | Southern Corn Rootworm Larvae | | | | Corn Earworm Larvae | | | |
|---|---|---|---|---|---|---|---|---|
| | Dead | Stunted | Total | Weight | Dead | Stunted | Total | Weight |
| 300 | 8 | 0 | 8 | 0 | 8 | 0 | 8 | 0 |
| 100 | 8 | 0 | 8 | 0 | 8 | 0 | 8 | 0 |
| 33 | 8 | 0 | 8 | 0 | 8 | 0 | 8 | 0 |
| 11 | 7 | 1 | 8 | 0.01 | 3 | 5 | 8 | 0.8 |
| 3.7 | 1 | 0 | 8 | 0.5 | 2 | 6 | 8 | 0.9 |
| 1.2 | 2 | 0 | 8 | 0.6 | 2 | 6 | 8 | 1.8 |
| 0.4 | 0 | 0 | 8 | 1.4 | 4 | 4 | 8 | 0.9 |
| 0 | 0 | 0 | 8 | 2.2 | 0 | 3 | 8 | 84.3 |

Binding Results: The rate of binding of TcdB2+TccC3 to XptA2 was compared to that of the 8920 fusion protein by SPR. The sensorgrams are shown in FIG. 1. The association rate of the 8920 fusion protein (ka=1.03×10⁶) was at least 20-fold greater than the association rate of TcdB2+TccC3 (ka=4.49×10⁴). Once bound, neither protein dissociated readily from XptA2. This increased rate of binding of the 8920 fusion protein to XptA2 is expected to increase the effectiveness of the XptA2+8920 complex, as compared to XptA2+TcdB2+TccC3. This is expectation is consistent with the observation shown above in this example (Table 13), that is, that lower concentrations of 8920 fusion protein are required to potentiate the Class A protein XptA2.

EXAMPLE 17

Construction of the Gene Encoding the Triple Fusion Protein 8836 (TcdB2/TccC3/XptA2$_{xwi}$)

This Example and Examples 18-20 relate to construction and testing of a translational fusion between three coding regions. The coding region of the 8920 (tcdB2/tccC3) double fusion of *Photorhabdus* TcdB2 (a Class B protein) and TccC3 (a Class C protein) was additionally fused to the coding region of the *Xenorhabdus* protein XptA2$_{xwi}$ (a Class A protein) to create the triple fusion gene tcdB2/tccC3/xptA2$_{xwi}$. This novel triple fused gene is called 8836 (SEQ ID NO:67) and encodes polypeptide 8836 (SEQ ID NO:68). This fusion protein differs from the 8811 triple fusion protein XptA2$_{xwi}$/TcdB2/TccC3 described in Example 14 above, in that the order of the coding regions corresponding to the individual proteins has been changed. Lysates containing the 8836 fusion protein demonstrated excellent functional activity. This invention reduces by two thirds the number of transcriptional control sequences required for expression in plants and other organisms and eliminates the disadvantages that accompany transformation of separate, complete genes. This invention also provides a mechanism for maintaining physical and temporal synchrony of translation for interacting proteins, particularly in eukaryotic cells. In addition, this example demonstrates that the order in which the coding regions corresponding to the Class A, Class B, and Class C proteins exist within a primary transcription product can be altered without interfering with the resulting activities of the translated fusion protein.

The 5' end of the coding region of the Toxin Complex Class A protein XptA2$_{xwi}$ was modified in a multi-step process, using standard molecular biology techniques. Likewise, the 3' end of the 8920 coding region was modified. The two modified coding regions were joined by a synthetic nucleotide linker to create a single open reading frame. The fused gene consisting of the linked coding regions for TcdB2, TccC3, and XptA2$_{xwi}$ was engineered as a single open reading frame, in a pET expression plasmid vector (Novagen, Madison Wis.). The construction was done in such a way as to maintain appropriate bacterial transcription and translation signals, and the resulting plasmid was designated pDAB8836. The DNA sequence of the fused coding region cassette is shown in SEQ ID NO:67. The cassette is 15,067 nucleotides in length and contains coding regions encoding TcdB2 (nts 484469), the TcdB2/TccC3 linker peptide (nts 4470-4511), TccC3 (nts 4512-7391), the TccC3/XptA2$_{xwi}$ linker peptide (nts 7392-7436) and XptA2$_{xwi}$ (nts 7437-15050). The polypeptide encoded by the fused gene in SEQ ID NO:67 is shown in SEQ ID NO:68. The fusion protein is predicted to contain 5,001 amino acids, with segments representing TcdB2 (residues 1-1474), the TcdB2/TccC3 linker peptide (residues 1475-1488), TccC3 (residues 1489-2448), the TccC3/XptA2$_{xwi}$ linker peptide (residues 2449-2463) and XptA2$_{xwi}$ (residues 2464-5001).

EXAMPLE 18

Expression Conditions for pDAB8836 and Lysate Preparations

The Class A TC protein XptA2$_{xwi}$ was utilized in a purified form prepared from cultures of *Pseudomonas fluorescens* heterologously expressing the gene. The expression plasmids pET (empty vector control), pDAB8920, and pDAB8836 were transformed into the *E. coli* T7 expression strain BL21 (DE3) Star (Invitrogen, Carlsbad, Calif.) using standard methods. Expression cultures were initiated with 10-200 freshly transformed colonies into 250 mL LB medium containing 50 µg/mL antibiotic and 75 µM IPTG (isopropyl-α-D-thiogalactopyranoside). The cultures were grown at 28° C. for 48 hours at 180-200 rpm. Then the cells were collected by centrifugation-at 5,000×g for 20 minutes at 4° C. After the cell pellets were suspended in 4-4.5 mL Butterfield's Phosphate solution (Hardy Diagnostics, Santa Maria, Calif.; 0.3 mM potassium phosphate pH 7.2), they were transferred to 50 mL polypropylene screw cap centrifuge tubes with 1 mL of 0.1 mm diameter glass beads (Biospec, Bartlesville, Okla., catalog number 1107901) and chilled on ice. The cells were lysed by sonication with two 45 second bursts using a 2 mm probe with a Branson Sonifier 250 (Danbury, Conn.) at an output of ~30, chilling completely between bursts. The lysates were transferred to 2 mL Eppendorf tubes and centrifuged 5 minutes at 16,000×g. Analysis of the lysates by SDS-PAGE as described above showed a Coomassie blue-staining band of greater than 500 kDa present in lysates of 8836, corresponding to the triple fusion 8836 protein (calculated size of 560.6 kDa). The high molecular weight band was not present in lysates of control cells.

EXAMPLE 19

Bioassay Conditions for the Triple Fusion 8836 Lysates

Insect bioassays were conducted with neonate corn earworm larvae, (*Helicoverpa zea* (Boddie)) on artificial diets in 128-well trays specifically designed for insect bioassays (C-D International, Pitman, N.J.). Bioassays were incubated under controlled environmental conditions (28° C., ~40% relative humidity, 16 h:8 h [Light:Dark]) for 5 days, at which point the total number of insects in the treatment, the number of dead insects, and the weights of surviving insects were recorded.

The biological activity of the crude lysates alone or with added XptA2$_{xwi}$ toxin protein was assayed as follows. Crude *E. coli* lysates (40 µL) (concentration ranging between 12-17 mg/mL) of either control cultures or those expressing Toxin Complex proteins were applied to the surface of artificial diet in 8 wells of a bioassay tray. The average surface area of treated diet in each well was ~1.5 cm². The empty vector control and TcdB2/TccC3 fusion protein 8920 lysates were applied with, and without, XptA2$_{xwi}$. The XptA2$_{xwi}$ protein was added as a highly purified preparation from bacterial cultures heterologously expressing the protein. Additionally, purified XptA2$_{xwi}$ was mixed with Butterfield's Phosphate solution as a control. The final concentration of XptA2$_{xwi}$ on the diet was 250 ng/cm².

EXAMPLE 20

Bioassay Results for Triple Fusion 8836 Lysates

Table 14 shows the bioassay results for control lysates, lysates of cells programmed to express the TcdB2/TccC3 fusion protein 8920, and lysates of cells programmed to express the triple TcdB2/TccC3/XptA2$_{xwi}$ fusion protein 8836. The control lysates and the 8920 lysates were bioassayed plus and minus purified XptA2$_{xwi}$. The data show that control lysates, with and without XptA2$_{xwi}$, had little effect on the insects. Lysates containing only the TcdB2/TccC3 fusion protein 8920 had no effect without added XptA2$_{xwi}$. However, with added XptA2, the 8920 lysate was a potent inhibitor of insect growth, as shown in the Examples above. Lysates programmed to express the triple TcdB2/TccC3/XptA2$_{xwi}$ fusion protein 8836 were extremely potent inhibitors of insect growth without added XptA2$_{xwi}$. These data, and the data from Example 14 above, demonstrate that triple fusion proteins consisting of XptA2$_{xwi}$, TcdB2 and TccC3 are functional and highly potent. Further, these data, together with those of Example 14, demonstrate the surprising result that the function of the triple fusion protein is preserved regardless of the order of the separate protein domains within the fusion protein.

TABLE 14

Response of corn earworm (*Helicoverpa zea* (Boddie) to *E. coli* lysates expressing Toxin Complex proteins.

| Sample | Lysate Tested | Growth Inhibition Corn Earworm |
|---|---|---|
| pET280 | Empty vector control | + |
| pET280 + XptA2$_{xwi}$ | Empty vector control | 0 |
| Purified XptA2$_{xwi}$ | XptA2$_{xwi}$ | 0 |
| pDAB8920 | 8920 (TcdB2/TccC3) | 0 |
| pDAB8920 + XptA2$_{xwi}$ | 8920 (TcdB2/TccC3) | ++++ |
| pDAB8836 | 8836 (TcdB2/TccC3/XptA2) | ++++ |

Eight insects used per test.
Growth Inhibition Scale:
0 = 0-20%;
+ = 21-40%;
++ = 41-60%;
+++ = 61-80%;
++++ = 81-100%.

SEQUENCE LISTING (85 sequences)

SEQ ID NO: 1 - DNA, 7409 bp, Photorhabdus luminescens
  misc_feature (48)..(4469): TcdB2 coding region
  misc_feature (4470)..(4511): Linker coding region
  misc_feature (4512)..(7394): TccC3 coding region
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatccgacaacaagggtcagactatccgcactaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 2 - protein, 2448 aa, Photorhabdus luminescens
  misc_feature (1)..(1474): TcdB2
  misc_feature (1475)..(1488): Linker
  misc_feature (1489)..(2248): TccC3
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSDNKGQTIRTRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 3 - DNA, 42 bp, Artificial Sequence
  Nucleotide sequence of tcdB2-tccC3 linker
ccgggatccgacaacaagggtcagactatccgcactaggcct

SEQ ID NO: 4 - protein, 14 aa, Artificial Sequence
  Protein sequence encoded by TcdB2-TccC3 linker
PGSDNKGQTIRTRP

SEQ ID NO: 5 - protein, 1476 aa, Photorhabdus luminescens
MQNSQTFSVTELSLPKGGGAITGMGEALTPAGPDGMAALSLPLPISAGRGYAPSLTLNYNSGTGNSPFGLGWDCGVMAIRRRTSTGVPNYDETDTFLGPEGEVLVVALNEAGQADIRSESSLQGINLGATFTVTCYRSRLESHFNRLEYWQPQTTGATDFWLIYSPDGQVHLLGKNPQARISNPLNVNQTAQWLLEASISSHSEQIYYQYRAEDEAGCETDELAAHPSATVQRYLQTVHYGNLTASDVFPTLNGDDPLKSGWMFCLVFDYGERKNSLSEMPLFKATGNWLCRKDRFSRYEYGFELRTRRLCRQILMFHRLQTLSGQAKGDDEPALVSRLILDYDENAMVSTLVSVRRVGHEDNNTVTALPPLELAYQPFEPEQTALWQSMDVLANFNTIQRWQLLDLKGEGVPGILYQDRNGWWYRSAQRQAGEEMNAVTWGKMQLLPITPAVQDNASLMDINGDGQLDWVITGPGLRGYHSQHPDGSWTRFTPLHALPIEYSHPRAQLADLMGAGLSDLVLIGPKSVRLYVNNRDGFTEGRDVVQSGDITLPLPGADARKLVAFSDVLGSGQAHLVEVSATQVTCWPNLGHGRFGQPIVLPGFSQSAASFNPDRVHLADLDGSGPADLIYVHADRLDIFSNESGNGFAKPFTLSFPDGLRFDDTCQLQVADVQGLGVVSLILSVPHMAPHHWRCDLTNAKPWLLSETNNNMGANHTLHYRSSVQFWLDEKAAALATGQTPVCYLPFPVHTLWQTETEDEISGNKLVTTLRYAHGAWDGREREFRGFGYVEQTDSHQLAQGNAPERTPPALTKSWYATGLPAVDNALSAGYWRGDKQAFAGFTPRFTLWKEGKDVPLTPEDDHNLYWLNRALKGQPLRSELYGLDGSAQQQIPYTVTESRPQVRQLQDGATVSPVLWASVVESRSYHYERIISDPQCNQDITLSSDLFGQPLKQVSVQYPRRNKPTTNPYPDTLPDTLFASSYDDQQQLLRLTCRQSSWHHLIGNELRVLGLPDGTRSDAFTYDAKQVPVDGLNLETLCAENSLIADDKPREYLNQQRTFYTDGKNQTPLKTPTRQALIAFTETAVLTESLLSAFDGGITPDELPGILTQAGYQQEPYLFPRTGENKVWVARQGYTDYGTEAQFWRPVAQRNSLLTGKMTLKWDTHYCVITQTQDAAGLTVSANYDWRFLTPTQLTDINDNVHLITLDALGRPVTQRFWGIESGVATGYSSSEEKPFSPPNDIDTAINLTGPLPVAQCLVYAPDSWMPLFSQETFNTLTQEEQETLRDSRIITEDWRICALTRRRWLQSQKISTPLVKLLTNSIGLPPHNLTLTTDRYDRDSEQQIRQQVAFSDGFGRLLQASVRHEAGEAWQRNQDGSLVTKVENTKTRWAVTGRTEYDNKGQTIRTYQPYFLNDWRYVSDDSARKEAYADTHIYDPIGREIRVITAKGWLRQSQYFPWFTVSEDENDTAADALV

SEQ ID NO: 6 - protein, 1474 aa, Photorhabdus luminescens
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKM

SEQ ID NO: 7 - protein, 1485 aa, Photorhabdus luminescens strain W14
MQDSPEVSITTLSLPKGGGAINGMGEALNAAGPDGMASLSLPLPLSTGRGTAPGLSLIYSNSAGNGPFGIGWQCGVMSISRRTQHGIPQYGNDDTFLSPQGEVMNIALNDQGQPDIRQDVKTLQGVTLPISYTVTRYQARQILDFSKIEYWQPASGQEGRAFWLISSPDGQLHILGKTAQACLANPQNDQQIAQWLLEETVTPAGEHVSYQYRAEDEAHCDDNEKTAHPNVTAQRYLVQVNYGNIKPQASLFVLDNAPPAPEEWLFHLVFDHGERDTSLHTVPTWDAGTAQWSVRPDIFSRYEYGFEVRTRRLCQQVLMFHRTALMAGEASTNDAPELVGRLILEYDKNASVTTLITIRQLSHESDGSPVTQPPLELAWQRFDLEKMPTWQRFDALDNFNSQQRYQLVDLRGEGLPGMLYQDRGAWWYKAPQRQEDGDSNAVTYDKIAPLPTLPNLQDNASLMDINGDGQLDWVVTASGIRGYHSQQPDGKWTHFTPINALPVEYFHPSIQFADLTGAGLSDLVLIGPKSVRLYANQRNGWRKGEDVPQSTGITLPVTGTDARKLVAFSDMLGSGQQHLVEIKANRVTCWPNLGHGRFGQPLTLSGFSQPENSFNPERLFLADIDGSGTTDLIYAQSGSLLIYLNQSGNQFDAPLTLALPEGVQFDNTCQLQVADIQGLGIASLILTVPHIAPHHWRCDLSLTKPWLLNVMNNNRGAHHTLHYRSSAQFWLDEKLQLTKAGKSPACYLPFPMHLLWYTEIQDEISGNRLTSEVNYSHGVWDGKEREFRGFGCIKQTDTTTFSHGTAPEQAAPSLSISWFATGMDEVDSQLATEYWQADTQAYSGFETRYTVWDHTNQTDQAFTPNETQRNWLTRALKGQLLRTELYGLDGTDKQTVPYTVSESRYQVRSIPVNKETELSAWVTAIENRSYHYERIITDPQFSQSIKLQHDIFGQSLQSVDIAWPRREKPAVNPYPPTLPETLFDSSYDDQQQLLRLVRQKNSWHHLTDGENWRLGLPNAQRRDVYTYDRSKIPTEGISLEILLKDDGLLADEKAAVYLGQQQTFYTAGQAEVTLEKPTLQALVAFQETAMMDDTSLQAYEGVIEEQELNTALTQAGYQQVARLFNTRSESPVWAARQGYTDYGDAAQFWRPQAQRNSLLTGKTTLTWDTHHCVIIQTQDAAGLTTQAHYDYRFLTPVQLTDINDNQHIVTLDALGRVTTSRFWGTEAGQAAGYSNQPFTPPDSVDKALALTGALPVAQCLVYAVDSWMPSLSLSQLSQSQEEAEALWAQLRAAHMITEDGKVCALSGKRGTSHQNLTIQLISLLASIPRLPPHVLGITTDRYDSDPQQQHQQTVSFSDGFGRLLQSSARHESGDAWQRKEDGGLVVDANGVLVSAPTDTRWAVSGRTEYDDKGQPVRTYQPYFLNDWRYVSDDSARDDLFADTHLYDPLGREYKVITAKKYLREKLYTPWFIVSEDENDTASRTP

SEQ ID NO: 8 - protein, 1493 aa, Xenorhabdus nematophilus
MQGSTPLKLEIPSLPSGGGSLKGMGEALNAVGAEGGASFSLPLPISVGRGLVPVLSLNYSSTAGNGSFGMGWQCGVGFISLRTAKGVPHYTGQDEYLGPDGEVLSIVPDSQGQPEQRTATSLLGTVLTQPHTVTRYQSRVAEKIVRLEHWQPQQRREEETSFWVLFTADGLVHLFGKHHHARIADPQDETRIARWLMEETVTHTGEHIYYHYRAEDDLDCDEHELAQHSGVTAQRYLAKVSYGNTQPETAFFAVKSGIPADNDWLFHLVFDYGERSSSLNSVPEFNVSENNVSENNVPEKWRCRPDSFSRYEYGFEIRTRRLCRQVLMFHQLKALAGEKVAEETPALVSRLILDYDLNNKVSLLQTARRLAHETDGTPVMMSPLEMDYQRVNHGVNLNWQSMPQLEKMNTLQPYQLVDLYGEGISGVLYQDTQKAWWYRAPVRDITAEGTNAVTYEEAKPLPHIPAQQESAMLLDINGDGRLDWVITASGLRGYHTMSPEGEWTPFIPLSAVPMEYFHPQAKLADIDGAGLPDLALIGPNSVRVWSNNRAGWDRAQDVIHLSDMPLPVPGRNERHLVAFSDMTGSGQSHLVEVTADSVRYWPNLGHGKFGEPLMMTGFQISGETFNPDRLYMVDIDGSGTTDFIYARNTYLELYANESGNHFAEPQRIDLPDGVRFDDTCRLQIADTQGLGTASIILTIPHMKVQHWRLDMTIFKPWLLNAVNNNMGTETTLYYRSSAQFWLDEKLQASESGMTVVSYLPFPVHVLWRTEVLDEISGNRLTSHYHYSHGAWDGLEREFRGFGRVTQTDIDSRASATQGTHAEPPAPSRTVNWYGTGVREVDILLPTEYWQGDQQAFPHFTPRFTRYDEKSGGDMTVTPSEQEEYWLHRALKGQRLRSELYGDDDSILAGTPYSVDESRTQVRLLPVMVSDVPAVLVSVAESRQYRYERVATDPQCSQKIVLKSDALGFPQDNLEIAYSRRPQPEFSPYPDTLPETLFTSSFDEQQMFLRLTRQRSSYHHLNHDDNTWITGLMDTSRSDARIYQADKVPDGGFSLEWFSATGAGALLLPDAAADYLGHQRVAYTGPEEQPAIPPLVAYIETAEFDERSLAAFEEVMDEQELTKQLNDAGWNTAKVPFSEKTDFHVWVGQKEFTEYAGADGFYRPLVQRETKLTGKTTVTWDSHYCVITATEDAAGLRMQAHYDYRFMVADNTTDVNDNYHTVTFDALGRVTSFRFWGTENGEKQGYTPAENETVPFIVPTTVDDALALKPGIPVAGLMVYAPLSWMVQASFSNDGELYGELKPAGIITEDGYLLSLAFRRWQQNNPAAAMPKQVNSQNPPHVLSVITDRYDADPEQQLRQTFTFSDGFGRTLQTAVRHESGEAWVRDEYGAIVAENHGAPETAMTDFRWAVSGRTEYDGKGQALRKYQPYFLNSWQYVSDDSARQDIYADTHYYDPLGREYQVITAKGGFRRSLFTPWFVVNEDENDTAGEMTA

SEQ ID NO: 9 - protein, 1506 aa, Xenorhabdus bovienii
MKQDSQDMTVTQLSLPKGGGAISGMGDTISNAGPDGMASLSVPLPISAGRGGAPNLSLNYSSGAGNGSFGIGWQSSTMAISRRTQHGVPQYHGEDTFLCPMGEVMAVAVNQSGQPDVRKTDKLLGGQLPVTYTVTRHQPRNIQHFSKLEYWQPPTDVETTPFWLMYSPDGQIHIFGKTEQAQIANPAEVSQIAQWLLEETVTPAGEHIYYQYRAEDDIGCDDSEKNAHPNASAQRYLTQVNYGNITPESSLLVLKNTPPADNEWLFHLVFDYGERAQEINTVPPFKAPSNNWKIRPDRFSRFEYGFEVRTRRLCQQILMFHRLKSLAGEQIDGEEIPALVARLLLSYDLNDSVTTLTAIRQMAYETDATLIALPPLEFDYQPFEAKVTQKWQEMPQLAGLNAQQPYQLVDLYGEGISGILYQDRPGAWWYQAPIRQKNVEDINAVTYSPINPLPKIPSQQDRATLMDIDGDGHLDWVIAGAGIQGRYSMQPNGEWTHFIPISALPTEYFHPQAQLADLVGAGLSDLALIGPRSVRLYANDRGNWKAGINVMPPDGVNLPIFGGDASSLVAFSDMLGSGQQHLVEIAAQSVKCWPNLGHGRFGAAILLPGFSQPNGTFNANQVFLADIDGSGTADIIYAHSTYLDIYLNESGNRFSAPVRLNLPEGVMFDNTCQLQVSDIQGLGAASIVLTVPHMTPRHWRYDFTHNKPWLLNVINNNRGAETTLFYRSSAQFWLDEKSQIEELGKFAASYLPFPIHLLWRNEALDEITGNRLTKVMNYAHGAWDGREREFCGFGRVTQIDTDEFAKGTTEKAPDENIYPSRSISWFATGLPEVDSQLPAEYWRGDDQAFAGFTPRFTRYEKGNAGQEGQDTPIKEPTETEAYWLNRAMKGQLLRSEVYGDDKTEKAKIPYTVTEARCQVRLIPSNDEAAPSSWTSIIENRSYHYERIVVDPSCKQQVVLKADEYGFPLAKVDIAYPRRNKPAQNPYPDSLPDTLFADSYDDQQKQLYLTKQQQSYYHLTQQDDWVLGLTDSRYSEVYHYAQTDAQSDIPKAGLILEDLLKVDGLIGKDKTFIYLGQQRVAYVGGDAEKPTRQVRVAYTETAAFDDNALHAFDGVIAPDELTQQLLAGGYLLVPQISDVAGSSEKVWVARQGYTEYGSAAQFYRPLIQRKSLLTGKYTLSWDTHYCVVVKTEDGAGMTTQAKYDYRFLLPAQLTDINDNQHIVTFNALGQVTSSRFWGTENGKISGYSTPESKPFTVPDTVEKALALQPTIPVSQCNIYVPDSWMRLLPQQSLTGQLKEGETLWNALHRAGVVTEDGLICELAYRRWIKRQATSSMMAVTLQQILAQTPRQPPHAMTITTDRYDSDSQQQLRQSIVLSDGFGRVLQSAQRHEAGEAWQRAEDGSLVVDNTGKPVVANTTTRWAVSGRTEYDGKGQAIRAYLPYYLNDWRYVSDDSARDDLYADTHFYDPLGREYQVKTAKGFWRENMFMPWFVVNEDENDTAARLTS

SEQ ID NO: 10 - protein, 1444 aa, Paenibacillus strain DAS1529
MPQSSNADIKLLSPSLPKGGGSMKGIEENIAAPGSDGMARCNVPLPVTSGRYITPDISLSYASGHGNGAYGMGWTMGVMSISRRTSRGTPSYTSEDQFLGPDGEVLVPESNEQGEIITRHTDTAQGIPLGETFTVTRYFPRIESAFHLLEYWEAQAGSATASFWLIHSADGVLHCLGKTAQARIAAPDDSAKIAEWLVEESVSPFGEHIYYQYKEEDNQGVNLEEDNHQYGANRYLKSIRYGNKVASPSLYVWKGEIPADGQWLYSVILDYGENDTSADVPPLYTPQGEWLVRPDRFSRYDYGFEVRTCRLCRQVLMFHVFKELGGEPALVWRMQLEYDENPAASMLSAVRQLAYEADGAIRSLPPLEFDYTPFGIETTADWQPFLPVPEWADEEHYQLVDLYGEGIPGLLYQNNDHWHYRSPARGDTPDGIAYNSWRPLPHIPVNSRNGMLMDLNGDGYLEWLLAEPGVAGRYSMNPDKSWSGFVPLQALPTEFFHPQAQLANVTGSGLTDLVMIGPKSVRFYAGEEAGFKRACEVWQQVGITLPVERVDKKELVAFSDMLGSGQSHLVRIRHDGVTCWPNLGNGVFGAPLALHGFTASEREFNPERVYLVDLDGSGASDIIYASRDALLIYRNLSGNGFADPVRVPLPDGVRFDNLCRLLPADIRGLGVASLVLHVPYMAPRSWKLDFFAAKPYLLQTVSNNLGASSSFWYRSSTQYWLDEKQAASSAVSALPFPINVVSDMHTVDEISGRTRTQKYTYRHGVYDRTEKEFAGFGRIDTWEEERDSEGTLSVSTPPVLTRTWYHTGQKQDEERAVQQYWQGDPAAFQVKPVRLTRFDAAAAQDLPLDSNNGQQEYWLYRSLQGMPLRTEIFAGDVGGSPPYQVESFRYQVRLVQSIDSECVALPMQLEQLTYNYEQIASDPQCSQQIQQWFDEYGVAAQSVTIQYPRRAQPEDNPYPRTLPDTSWSSSYDSQQMLLRLTRQRQKAYHLADPEGWRLNIPHQTRLDAFIYSADSVPAEGISAELLEVDGTLRSSALEQAYGGQSEIIYAGGGEPDLRALVHYTRSAVLDEDCLQAYEGVLSDSQLNSLLASSGYQRSARILGSGDEVDIFVAEQGFTRYADEPNFFRILGQQSSLLSGEQVLTWDDNFCAVTSIEDALGNQIQIAYDYRFVEAIQITDTNNNVNQVALDALGRVVYSRTWGTEEGIKTGFRPEVEFATPETMEQALALASPLPVASCCVYDAHSWMGTITLAQLSELVPDSEKQWSFLIDNRLIMPDGRIRSRGRDPWSLHRLLPPAVGELLSEADRKPPHTVILAADRYPDDPSQQIQASIVFSDGFGRTIQTAKREDTRWAIAERVDYDGTGAVIRSFQPFYLDDWNYVGEEAVSSSMYATIYYYDALARQLRMVNAKGYERRTAFYPWFTVNEDENDTMDSSLFASPPAR

SEQ ID NO: 11 - protein, 1428 aa, Serratia entomophila
MQNHQDMAITAPTLPSGGGAVTGLKGDIAAAGPDGAATLSIPLPVSPGRGYAPTGALNYHSRSGNGPFGIGWGIGGAAVQRRTRNGAPTYDDTDEFTGPDGEVLVPALTAAGTQEARQATSLLGINPGGSFNVQVYRSRTEGSLSRLERWLPADETETEFWVLYTPDGQVALLGRNAQARISNPTAPTQTAVWLMESSVSLTGEQMYYQYRAEDDDGCDEAERDAHPQAGAQRYPVAVWYGNRQAARTLPALVSTPSMDSWLFILVFDYGERSSVLSEAPAWQTPGSGEWLCRQDCFSGYEFGFNLRTRRLCRQVLMFHYLGVLAGSSGANDAPALISRLLLDYRESPSLSLLENVHQVAYESDGTSCALPALALGWQTFTPPTLSAWQTRDDMGKLSLLQPYQLVDLNGEGVVGILYQDSGAWWYREPVRQSGDDPDAVTWGAAAALPTMPALHNSGILADLNGDGRLEWVVTAPGVAGMYDRTPGRDWLHFTPLSALPVEYAHPKAVLADILGAGLTDMVLIGPRSVRLYSGKNDGWNKGETVQQTERLTLPVPGVDPRTLVAFSDMAGSGQQHLTEVRANGVRYWPNLGHGRFGQPVNIPGFSQSVTTFNPDQILLADTDGSGTTDLIYAMSDRLVIYFNQSGNYFAEPHTLLLPKGVRYDRTCSLQVADIQGLGVPSLLLTVPHVAPHHWVCHLSADKPWLLNGMNNNMGARHALHYRSSVQFWLDEKAEALAAGSSPACYLPFTLHTLWRSVVQDEITGNRLVSDVLYRHGVWDGQEREFRGFGFVEIRDTDTLASQGTATELSMPSVSRNWYATGVPAVDERLPETYWQNDAAAFADFATRFTVGSGEDEQTYTPDDSKTFWLQRALKGILLRSELYGADGSSQADIPYSVTESRPQVRLVEANGDYPVVWPMGAESRTSVYERYHNDPQCQQQAVLLSDEYGFPLRQVSVNYPRRPPSADNPYPASLPATLFANSYDEQQQILRLGLQQSSAHHLVSLSEGHWLLGLAEASRDDVFTYSADNVPEGGLTLEHLLAPESLVSDSQVGTLAGQQQVWYLDSQDVATVAAPPLPPKVAFIETAVLDEGMVSSLAAYIVDEHLEQAGYRQSGYLFPRGREAEQALWTQCQGYVTYAGAEHFWLPLSFRDSMLTGPVTVTRDAYDCVITQWQDAAGIVTTADYDWRFLTPVRVTDPNDNLQSVTLDALGRVTTLRFWGTENGIATGYSDATLSVPDGAAAALALTAPLPVAQCLVYVTDSWGDDDNEKMPPHVVVLATDRYDSDTGQQVRQQVTFSDGFGRELQSATRQAEGNAWQRGRDGKLVTASDGLPVTVATNFRWAVTGRAEYDNKGLPVRVYQPYFLDSWQYVSDDSARQDLYADTHFYDPTAREWQVITAKGERRQVLYTPWFVVSEDENDTVGLNDAS

SEQ ID NO: 12 - protein, 1043 aa, Photorhabdus luminescens
MSPSETTLYTQTPTVSVLDNRGLSIRDIGFHRIVIGGDTDTRVTRHQYDARGHLNYSIDPRLYDAKQADNSVKPNFVWQHDLAGHALRTESVDAGRTVALNDIEGRSVMTMNATGVRQTRRYEGNTLPGRLLSVSEQVFNQESAKVTERFIWAGNTTSEKEYNLSGLCIRHYDTAGVTRLMSQSLAGAMLSQSHQLLAEGQEANWSGDDETVWQGMLASEVYTTQSTTNAIGALLTQTDAKGNIQRLAYDIAGQLKGSWLTVKGQSEQVIVKSLSWSAAGHKLREEHGNGVVTEYSYEPETQRLIGITTRRAEGSQSGARVLQDLRYKYDPVGNVISIHNDAEATRFWRNQKVEPENRYVYDSLYQLMSATGREMANIGQQSNQLPSPVIPVPTDDSTYTNYLRTYTYDRGGNLVQIRHSSPATQNSYTTDITVSSRSNRAVLSTLTTDPTRVDALFDSGGHQKMLIPGQNLDWNIRGELQRVTPVSRENSSDSEWYRYSSDGMRLLKVSEQQTGNSTQVQRVTYLPGLELRTTGVADKTTEDLQVITVGEAGRAQVRVLHWESGKPTDIDNNQVRYSYDNLLGSSQLELDSEGQILSQEEYYPYGGTAIWAARNQTEASYKFIRYSGKERDATGLYYYGYRYYQPWVGRWLSADPAGTVDGLNLYRMVRNNPITLTDHDGLAPSPNRNRNTFWFASFLFRKPDEGMSASMRRGQKIGRAIAGGIAIGGLAATIAATAGAAIPVILGVAAVGAGIGALMGYNVGSLLEKGGALLARLVQGKSTLVQSAAGAAAGASSAAAYGARAQGVGVASAAGAVTGAVGSWINNADRGIGGAIGAGSAVGTIDTMLGTASTLTHEVGAAAGGAAGGMITGTQGSTRAGIHAGIGTYYGSWIGFGLDVASNPAGHLANYAVGYAAGLGAEMAVNRIMGGGFLSRLLGRVVSPYAAGLARQLVHFSVARPVFEPIFSVLGGLVGGIGTGLHRVMGRESWISRALSAAGSGIDHVAGMIGNQIRGRVLTTTGIANAIDYGTSAVGAARRVFSL

SEQ ID NO: 13 - protein, 915 aa, Photorhabdus luminescens
MSSYNSAIDQKTPSIKVLDNRKLNVRTLEYLRTQADENSDELITFYEFNIPGFQVKSTDPRKNKNQSGPNFIRVFNLAGQVLREESVDAGRTITLNDIESRPVLIINATGVRQNHRYEDNTLPGRLLAITEQVQAGEKTTERLIWAGNTPQEKDYNLAGQCVRHYDTAGLTQLNSLSLAGVVLSQSQQLLTDNQDADWTGEDQSLWQQKLSSDVYITQSNTDATGALLTQTDAKGNIQRLAYDVAGQLKGSWLTLKGQAEQVIIKSLTYSAAGQKLREEHGNGIVTEYSYEPETQRLIGITTRRPSDAKVLQDLRYQYDPVGNVINIRNDAEATRFWRNQKVAPENSYTYDSLYQLISATGREMANIGQQNNQLPSPALPSDNNTYTNYTRSYSYDHSGNLTQIRHSSPATQNNYTVAITLSNRSNRGVLSTLTTDPNQVDTLFDAGGHQTSLLPGQTLIWTPRGELKQVNNGPGNEWYRYDSNGMRQLKVSEQPTQNTTQQQRVIYLPGLELRTTQSNATTTEELHVITLGEAGRAQVRVLHWESGKPEDVNNNQLRYSYDNLIGSSQLELDNQGQIISEEEYYPFGGTALWAANSQTEASYKTIRYSGKERDATGLYYYGYRYYQPWAGRWLSADPAGTIDGLNLYRMVRNNPVSLQDENGLAPEKGKYTKEVNFFDELKFKLAAKSSHVVKWNEKESSYTKNKSLKVVRVGDSDPSGYLLSHEELLKGIEKSQIIYSRLEENSSLSEKSKTNLSLGSEISGYMARTIQDTISEYAEEHKYRSNHPDFYSETDFFALMDKSEKNDYSGERKIYAAMEVKVYHDLKNKQSELHVNYALAHPYTQLSNEERALLQETEPAIAIDREYNFKGVGKFLTMKAIKKSLKGHKINRISTEAINIRSAAIAENLGMRRTS

SEQ ID NO: 14 - protein, 960 aa, Photorhabdus luminescens
MKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 15 - protein, 949 aa, Photorhabdus luminescens
MKNIDPKLYQHTPTVNVYDNRGLTIRNIDFHRDVAGGDTDTRITRHQYDTRGHLSQSIDPRLYDAKQTNNSTNPNFLWQYNLTGDTLRTESVDAGRTVALNDIEGRQVLIVTATGAIQTRQYEANTLPGRLLSVSEQAPGEQTPRVTEHFIWAGNTQAEKDHNLAGQYVRHYDTAGVTQLESLSLTENILSQSRQLLADGQEADWTGNDETLWQTKLNSETYTTQSTFDATGALLTQTDAKGNMQRLAYNVAGQLQGSWLTLKNQSEQVIVKSLTYSAAGQKLREEHGNGVITEYSYEPETLRLIGTTTRRQSDSKVLQDLRYEHDPVGNIISVRNDAEATRFWRNQKIVPENTYTYDSLYQLISATGREMANIGQQSNQLPSPIIPLPTDENSYTNYTRSYNYDRGGNLVQIRHSSPAAQNNYTTDITVSNRSNRAVLSSLTSDPTQVEALFDAGGHQTKLLPGQELSWNTRGELKQVTPVSRESASDREWYRYGNDGMRRLKVSEQQTGNSTQQQRVTYLPDLELRTTQNGTTTSEDLHAITVGAAGHAQVRVLHWETTPPAGINNNQLRYSYDNLIGSSQLELDNAGQIISQEEYYPFGGTALWAARNQIEASYKILRYSGKERDATGLYYYGYRYYQPWVGRWLSADPAGTIDGLNLYRMVRNNPSTLVDISGLAPTKYNIPGFDFDVEIDEQKRSKLKPTLIRIKDEFLHYGPVDKLLEEKKPGLNVPEELFDRGPSENGVSTLTFKKDLPISCISNTEYTLDILYNKHETKPFPYENEATVGADLGVIMSVEFGNKSIGNASDEDLKEEHLPLGKSTMDKTDLPDLKQGLMIAEKIKSGKGAYPFHFGAAIAVVYGEDKKVAASILTDLSEPKRDEGEYLQSTRKVSAMFITNVNEFRGHDYPKSKYSIGLVTAEKRQPVISKKRANPEEAPSSSRNKKLHVH

SEQ ID NO: 16 - protein, 938 aa, Photorhabdus luminescens strain W14
MENIDPKLYHHTPTVSVHDNRGLAIRNISFHRTTAEANTDTRITRHQYNAGGYLNQSIDPRLYDAKQTNNAVQPNFIWRHNLTGNILRTESVDAGRTITLNDIEGRPVLTINAAGVRQNHRYEDNTLPGRLLAISEQGQAEEKTTERLIWAGNTPQEKDHNLAGQCVRHYDTAGLTQLNSLALTGAVLSQSQQLLTDNQDADWTGEDQSLWQQKLSSDVYITQSNTDATGALLTQTDAKGNIQRLAYDVAGQLKGSWLTLKGQAEQVIIKSLTYSAAGQKLREEHGNGIVTEYSYEPETQRLIGITTRRPSDAKVLQDLRYQYDPVGNVISIRNDAEATRFWRNQKVAPENSYTYDSLYQLISATGREMANIGQQSNQLPSPALPSDNNTYTNYTRTYTYDRGGNLTKIQHSSPAAQNNYTTDITVSNRSNRAVLSTLTADPTQVDALFDAGGHQTSLLSGQVLTWTPRGELKQANNSAGNEWYRYDSNGIRQLKVNEQQTQNIPQQQRVTYLPGLEIRTTQNNATTTEELHVITLGKAGRAQVRVLHWESGKPEDINNNQLRYSYDNLIGSSQLQLDSDGQIISEEEYYPFGGTALWAARNQTEASYKTIRYSGKERDVTGLYYYGYRYYQPWAGRWLGADPAGTIDGLNLYRMVRNNPVTQFDVQGLSPANRTEEAIIKQGSFTGMEEAVYKKMAKPQTFKRQRAIAAQTEQEAHESLTNNPSVDISPIKNYTTDSSQINAAIRENRITPAVESLDATLSSLQDRQMRVTYRVMTYVDNSTPSPWHSPQEGNSINVGDIVSDNAYLSTSAHRGFLNFVHKKETSETRYVKMAFLTNAGVNVPAASMYNNAGEEQVFKMDLNDSRKSLAEKLKLRVSGPQSGQAEILLPRETQFEVVSMKHQGRDTYVLLQDINQSAATHRNVRNTYTGNFKSSSAN

SEQ ID NO: 17 - protein, 1016 aa, Xenorhabdus nematophilus
MKNFVHSNTPSVTVLDNRGQTVREIAWYRHPDTPQVTDERITGYQYDAQGSLTQSIDPRFYERQQTASDKNAITPNLILLSSLSKKALRTQSVDAGTRVALHDVAGRPVLAVSANGVSRTFQYESDNLPGRLLTITEQVKGENACITERLIWSGNTPAEKGNNLAGQCVVHYDPTGMNQTNSISLTSIPLSITQQLLKDDSEADWHGMDESGWKNALAPESFTSVSTTDATGTVLTSTDAAGNKQRIAYDVAGLLQGSWLALKGKQEQVIVKSLTYSAASQKLREEHGNGIVTTYTYEPETQRVIGIKTERPSGHAAGEKILQNLRYEYDPVGNVLKSTNDAEITRFWRNQKIVPENTYTYDSLYQLVSVTGREMANIGRQKNQLPIPALIDNNTYTNYSRTYDYDRGGNLTRIRHNSPITGNNYTTNMTVSDHSNRAVLEELAQDPTQVDMLFTPGGHQTRLVPGQDLFWTPRDELQQVILVNRENTTPDQEFYRYDADSQRVIKTHIQKTGNSEQIQRTLYLPELEWRTTYSGNTLKEFLQVITVGESGQAQVRVLHWETGKPADISNDQLRYSYGNLIGSSGLELDSDGQIISQEEYYPYGGTAVWAARSQSEADYKTVRYSGKERDATGLYYYGYRYYQSWTGRWLSVDPAGEVDGLNLFRMCRNNPIVFSDSDGRFPGQGVLAWIGKKAYRKAVNITTEHLLEQGASFDTFLKLNRGLRTFVLGVGVASLGVKAATIAGASPWGIVGAAIGGFVSGAVMGFFANNISEKIGEVLSYLTRKRSVPVQVGAFVVTSLVTSALFNSSSTGTAISAATAVTVGGLMALAGEHNTGMAISIATPAGQGTLDTLRPGNVSAPERLGALSGAIIGGILLGRHQGSSELGERAAIGAMYGARWGRIIGNLWDGPYRFIGRLLLRRGISSAISHAVSSRSWFGRMIGESVGRNISEVLLPYSRTPGEWVGAAIGGTAAAAHHAVGGEVANAASRVTWSGFKRAFNNFFFNASARHNESEA

SEQ ID NO: 18 - protein, 962 aa, Xenorhabdus bovienii
MNVFNPTLYAGTPTVTVMDNRGLSVRDIAYHRTTAGEQADTRITRHQYSPHNFLIESIDPRLFDLQSQSTIKPNFTYCPALKGDVLRTESVDAGQTVILSDIEGRPLLNISAMGVVKHWQYEESTLPGRLLAVSERKNEASTPQIIERFIWSGNSPSEKDHNLAGKYLRHYDTAGLNQLNAVSLTSVDLSQSRQLLQDDVTADWSGSDESQWKTRLSNDIFTTEITADAVGNFLTQNDAKSNQQRLSYDVAGQLKASWLTIKGQNEQVIVNSLTYSAAGQKLREEQGNGVVTEYSYEAQTWRLIGVTAYRQSDKKRLQDLVYNYDPVGNLLNIRNNAEATRFWRNQIVEPENHYAYDSLYQLISASGREIASIGQQGSRLPVPIIPLPANDDVYTRYTRTYHYDRGGNLCQIRHCAPATDNKYTTKITVSNRSNRAVWDTLTTDPAKVDTLFDHGGHQLQLQSGQTLCWNYRGELQQITKIQRDEKPADKERYRYGVGAARVVKISTQQAGGSSHVQRVVYLPGLELRTTQHDATLIEDLQVIIMGEAGRAQVRVLHWEIPPPDNLNNDSLRYSYDSLMGSSQLELDGAGQIITQEEYYPYGGTAIWAARNQTEANYKTIRYSGKERDATGLYYYGHRYYQPWLGRWLSADPAGTVDGLNLYRMVRNNPITYRDADGLAPIGDKISEGIYEPELRVGLERDDPNVRDYDRVYPDTAKTEMIEATATTIAPSQMLSAHAFASVPILTDLFNPQTARLSQKTTDIVLNTQGGGDLIFTGMNIKGKGKEFNALKIVDTYGGEMPDSKTAISAYWLPQGGYTDIPIHPTGIQKYLFTPAFSGCTLAVDKLNENTLRAYHVEGSKEDAQYNNLAVAAHGEGLVMAMEFPDYGFHTDKTGQRLRNTQGFAFMSYNQSQKKWEIHYQRQALTSNTGIMNVSAKNKIRLNAPSHVKNSSIKGTEIMTTHF

SEQ ID NO: 19 - protein, 953 aa, Paenibacillus strain DAS1529
MKMIPWTHHYLLHRLRGEMEVKPMNTTSIYRGTPTISVVDNRNLEIRILQYNRIAAEDPADECILRNTYTPLSYLGSSMDPRLFSQYQDDRGTPPNIRTMASLRGEALCSESVDAGRKAELFDIEGRPVWLIDANGTETTLEYDVLGRPTAVFEQQEGTDSPQCRERFIYGEKEADAQANNLRGQLVRHYDTAGRIQTDSISLAGLPLRQSRQLLKNWDEPGDWSMDEESAWASLLAAEAYDTSWRYDAQDRVLAQTDAKGNLQQLTYNDAGQPQAVSLKLQGQAEQRIWNRIEYNAAGQVDLAEAGNGIVTEYTYEESTQRLIRKKDSRGLSSGEREVLQDYRYEYDPVGNILSIYNEAEPVRYFRNQAVAPKRQYAYDALYQLVSSSGRESDALRQQTSLPPLITPIPLDDSQYVNYAEKYSYDQAGNLIKLSHNGASQYTTNVYVDKSSNRGIWRQGEDIPDIAASFDRAGNQQALFPGRPLEWDTRNQLSRVHMVVREGGDNDWEGYLYDSSGMRIVKRSTRKTQTTTQTDTTLYLPGLELRIRQTGDRVTEALQVITVDEGAGQVRVLHWEDGTEPGGIANDQYRYSLNDHLTSSLLEVDGQGQIISKEEFYPYGGTALWTARSEVEASYKTIRYSGKERDATGLYYYGHRYYMPWLGRWLNPDPAGMVDGLNLYRMVRNNPIGLMDPNGNAPINVADYSFVHGDLVYGLSKERGRYLKLFNPNFNMEKSDSPAMVIDQYNNNVALSITNQYKVEELMKFQKDPQKAARKIKVPEGNRLSRNENYPLWHDYINIGEAKAAFKASHIFQEVKGNYGKDYYHKLLLDRMIESPLLWKRGSKLGLEIAATNQRTKIHFVLDNLNIEQVVTKEGSGGQSITASELRYIYRNRERLNGRVIFYRNNERLDQAPWQENPDLWSKYQPGLRQSSSSRVKERGIGNFFRRFSMKRK

SEQ ID NO: 20 - protein, 930 aa, Paenibacillus strain DAS1529
MNTTSIYRGTPTISVVDNRNLEIRILQYNRIAAEDPADECILRNTYTPLSYLGSSMDPRLFSQYQDDRGTPPNIRTMASLRGEALCSESVDAGRKAELFDIEGRPVWLIDANGTETTLEYDVLGRPTAVFEQQEGTDSPQCRERFIYGEKEADAQANNLRGQLVRHYDTAGRIQTDSISLAGLPLRQSRQLLKNWDEPGDWSMDEESAWASLLAAEAYDTSWRYDAQDRVLAQTDAKGNLQQLTYNDAGQPQAVSLKLQGQAEQRIWNRIEYNAAGQVDLAEAGNGIVTEYTYEESTQRLIRKKDSRGLSSGEREVLQDYRYEYDPVGNILSIYNEAEPVRYFRNQAVAPKRQYAYDALYQLVSSSGRESDALRQQTSLPPLITPIPLDDSQYVNYAEKYSYDQAGNLIKLSHNGASQYTTNVYVDKSSNRGIWRQGEDIPDIAASFDRAGNQQALFPGRPLEWDTRNQLSRVHMVVREGGDNDWEGYLYDSSGMRIVKRSTRKTQTTTQTDTTLYLPGLELRIRQTGDRVTEALQVITVDEGAGQVRVLHWEDGTEPGGIANDQYRYSLNDHLTSSLLEVDGQGQIISKEEFYPYGGTALWTARSEVEASYKTIRYSGKERDATGLYYYGHRYYMPWLGRWLNPDPAGMVDGLNLYRMVRNNPIGLMDPNGNAPINVADYSFVHGDLVYGLSKERGRYLKLFNPNFNMEKSDSPAMVIDQYNNNVALSITNQYKVEELMKFQKDPQKAARKIKVPEGNRLSRNENYPLWHDYINIGEAKAAFKASHIFQEVKGNYGKDYYHKLLLDRMIESPLLWKRGSKLGLEIAATNQRTKIHFVLDNLNIEQVVTKEGSGGQSITASELRYIYRNRERLNGRVIFYRNNERLDQAPWQENPDLWSKYQPGLRQSSSSRVKERGIGNFFRRFSMKRK

SEQ ID NO: 21 - protein, 973 aa, Serratia entomophila
MSTSLFSSTPSVAVLDNRGLLVRELQYYRHPDTPEETDERITCHQHDERGSLSQSADPRLHAAGLTNFTYLNSLTGTVLQSVSADAGTSLELSDAAGRAFLAVTGAGTEDAVTRTWQYEDDTLPGRPLSITEQVTGEAAQITERFVYAGNTDAEKILNLAGQCVSHYDTAGLVQTDSIALSGVPLAVTRQLLPDAAGANWMGEDASAWNDLLDGETFFTQTHADATGAVLSITDAKGNLQRVAYDVAGLLSGSWLTLKDGTEQVIVASLTYSAAGKKLREEHGNGVVTSYIYEPETQRLTGIKTERPSGHVAGAKVLQDLRYTYDPVGNVLSVNNDAEETRFWRNQKVVPENTYIYDSLYQLVSATGREMANAGQQGNDLPSATAPLPTDSSAYTNYTRTYRYDRGGNLTQMRHSAPATNNNYTTDITVSDRSNRAVLSTLAEVPSDVDMLFSAGGHQKHLQPGQALVWTPRGELQKVTPVVRDGGADDSESYRYDAGSQRIIKTGTRQTGNNVQTQRVVYLPGLELRIMANGVTEKESLQVITVGEAGRAQVRVLHWEIGKPDDLDEDSVRYSYDNLVGSSQLELDREGYLISEEEFYPYGGTAVLTARSEVEADYKTIRYSGKERDATGLDYYGYRYYQPWAGRWLSTDPAGTVDGLNLFRMVRNNPVTLFDSNGRISTGQEARRLVGEAFVHPLHMPVFERISVERKISMSVREAGIYTISALGEGAAAKGHNILEKTIKPGSLKAIYGDKAESILGLAKRSGLVGRVGQWDASGVRGIYAHNRPGGEDLVYPVSLQNTSANEIVNAWIKFKIITPYTGDYDMHDIIKFSDGKGHVPTAESSEERGVKDLINKGVAEVDPSRPFEYTAMNVIRHGPQVNFVPYMWEHEHDKVVNDNGYLGVVASPGPFPVAMVHQGEWTVFDNSEELFNFYKSTNTPLPEHWSQDFMDRGKGIVATPRHAELLDKRRVMY

SEQ ID NO: 22 - protein, 2523 aa, Xenorhabdus nematophilus
MIKVNELLDKINRKRSGDTLLLTNISFMSFSEFRHRTSGTLTWRETDFLYQQAHQESKQNKLEELRILSRANPQLANTTNLNITPSTLNNSYNSWFYGRAHRFVKPGSIASIFSPAAYLTELYREAKDFHPDNSQYHLNKRRPDIASLALTQNNMDEEISTLSLSNELLLHNIQTLEKTDYNGVMKMLSTYRQTGMTPYHLPYESARQAILLQDKNLTAFSRNTDVAELMDPTSLLAIKTDISPELYQILVEEITPENSTELMKKNFGTDDVLIFKSYASLARYYDLSYDELSLFVNLSFGKKNTNQQYKNEQLITLVNDGNDTATARLIKRTRKDFYDSHLNYAELIPIKENEYKYNFSVKKTEPDHLDFRLQNGDKEYIYQDKNFVPIANTHYSIPIKLTTEQITNGITLRLWRVKPNPSDAINANAYFKMMEFPGDIFLLKLNKAIRLYKATGISPEDIWQVIESIYDDLTIDSNVLGKLFYVQYYMQHYNISVSDALVLCHSDISQYSTKQQPSHFTILFNTPLLNGQEFSADNTKLDLTPGESKNHFYLGIMKRAFRVNDTELYTLWKLANGGTNPEFMCSIENLSLLYRVRLLADIHHLTVNELSMLLSVSPYVNTKIALFSDTALTQLISFLFQCTQWLTTQKWSVSDVFLMTTDNYSTVLTPDIENLITTLSNGLSTLSLGDDELIRAAAPLIAASIQMDSAKTAETILLWINQIKPQGLTFDDFMIIAANRDRSENETSNMVAFCQVLGQLSLIVRNIGLSENELTLLVTKPEKFQSETTALQHDLPTLQALTRFHAVIMRCGSYATEILTALELGALTAEQLAVALKFDAQVVTQALQQTGLGVNTFTNWRTIDVTLQWLDVAATLGITPDGVAALIKLKYIGEPETPMPTFDDWQAASTLLQAGLNSQQSDQLQAWLDEATTTAASAYYIKNSAPQQIKSRDELYSYLLIDNQVSAQVKTTRVAEAIASIQLYVNRALNNVEGKVSKPVKTRQFFCDWETYNRRYSTWAGVSELAYYPENYIDPTIRIGQTGMMNNLLQQLSQSQLNIDTVEDSFKNYLTAFEDVANLQVISGYHDSINVNEGLTYLIGYSQTEPRIYYWRNVDHQKCQHGQFAANAWGEWKKIEIPINVWQENIRPVIYKSRLYLLWLEQKELKNESEDGKIDITDYILKLSHIRYDGSWSSPFNFNVTDKIENLINKKASIGMYCSSDYEKDVIIVYFHEKKDNYSFNSLPAREGMTINPDMTLSILTENDLDAIVKSTLSELDTRTEYKVNNQFATDYLAEYKESITTKNKLASFTGNIFDLSYISPGNGHINLTFNPSMEINFSKGNIYNDEVKYLLSMVEDETVILFDYDRHDEMLGKEEEVFHYGTLDFIISIDLKNAEYFRVLMHLRTKEKIPRKSEIGVGINYDYESNDAEFKLDTNIVLDWKDNTGVWHTICESFTNDVSIINNMGNIAALFLREDPCVYLCSIATDIKIASSMIEQIQDKNISFLLKNGSDILVELNAEDHVASKPSHESDPMVYDFNQVKVDIEGYDIPLVSEFIIKQPDGGYNDIVIESPIHIKLKSKDTSNVISLHKMPSGTQYMQIGPYRTRLNTLFSRKLAERANIGIDNVLSMETQNLPEPQLGEGFYATFKLPPYNKEEHGDERWFKIHIGNIDGNSARQPYYEGMLSDIETTVTLFVPYAKGYYIREGVRLGVGYKKIIYDKSWESAFFYFDETKNQFIFINDADHDSGMTQQGIVKNIKKYKGFIHVVVMKNNTEPMDFNGANAIYFWELFYYTPMMVFQRLLQEQNFTESTRWLRYIWNPAGYSVQGEMQDYYWNVRPLEEDTSWNANPLDSVDPDAVAQHDPMHYKVATFMKMLDLLITRGDSAYRQLERDTLNEAKMWYVQALTLLGDEPYFSLDNDWSEPRLEEAASQTMRHHYQHKMLQLRQRAALPTKRTANSLTALFLPQINKKLQGYWQTLTQRLYNLRHNLTIDGQPLSLSLYATPADPSMLLSAAITASQGGGDLPHAVMPMYRFPVILENAKWGVSQLIQFGNTLLSITERQDAEALAEILQTQGSELALQSIKMQDKVMAEIDADKLALQESRHGAQSRFDSFNTLYDEDVNAGEKQAMDLYLSSSVLSTSGTALHMAAAAADLVPNIYGFAVGGSRFGALFNASAIGIEISASATRIAADKISQSEIYRRRRQEWEIQRNNAEAEIKQIDAQLATLAVRREAAVLQKNYLETQQAQTQAQLAFLQSKFSNAALYNWLRGRLSAIYYQFYDLAVSLCLMAEQTYQYELNNAAAHFIKPGAWHGTYAGLLAGETLMLNLAQMEKSYLEKDERALEVTRTVSLAEVYAGLTENSFILKDKVTELVNAGEGSAGTTLNGLNVEGTQLQASLKLSDLNIATDYPDGLGNTRRIKQISVTLPALLGPYQDVRAILSYGGSTMMPRGCKAIAISHGMNDSGQFQMDFNDAKYLPFEGLPVADTGTLTLSFPGISGKQKSLLLSLSDIILHIRYTIRS

SEQ ID NO: 23 - protein, 2538 aa, Xenorhabdus nematophilus
MYSTAVLLNKISPTRDGQTMTLADLQYLSFSELRKIFDDQLSWGEARHLYHETIEQKKNNRLLEARIFTRANPQLSGAIRLGIERDSVSRSYDEMFGARSSSFVKPGSVASMFSPAGYLTELYREAKDLHFSSSAYHLDNRRPDLADLTLSQSNMDTEISTLTLSNELLLEHITRKTGGDSDALMESLSTYRQAIDTPYHQPYETIRQVIMTHDSTLSALSRNPEVMGQAEGASLLAILANISPELYNILTEEITEKNADALFAQNFSENITPENFASQSWIAKYYGLELSEVQKYLGMLQNGYSDSTSAYVDNISTGLVVNNESKLEAYKITRVKTDDYDKNINYFDLMYEGNNQFFIRANFKVSREFGATLRKNAGPSGIVGSLSGPLIANTNFKSNYLSNISDSEYKNGVKIYAYRYTSSTSATNQGGGIFTFESYPLTIFALKLNKAIRLCLTSGLSPNELQTIVRSDNAQGIINDSVLTKVFYTLFYSHRYALSFDDAQVLNGSVINQYADDDSVSHFNRLFNTPPLKGKIFEADGNTVSIDPDEEQSTFARSALMRGLGVNSGELYQLGKLAGVLDAQNTITLSVFVISSLYRLTLLARVHQLTVNELCMLYGLSPFNGKTTASLSSGELPRLVIWLYQVTQWLTEAEITTEAIWLLCTPEFSGNISPEISNLLNNLRPSISEDMAQSHNRELQAEILAPFIAATLHLASPDMARYILLWTDNLRPGGLDIAGFMTLVLKESLNANETTQLVQFCHVMAQLSLSVQTLRLSEAELSVLVISGFAVLGAKNQPAGQHNIDTLFSLYRFHQWINGLGNPGSDTLDMLRQQTLTADRLASVMGLDISMVTQAMVSAGVNQLQCWQDINTVLQWIDVASALHTMPSVIRTLVNIRYVTALNKAESNLPSWDEWQTLAENMEAGLSTQQAQTLADYTAERLSSVLCNWFLANIQPEGVSLHSRDDLYSYFLIDNQVSSAIKTTRLAEAIAGIQLYINRALNRIEPNARADVSTRQFFTDWTVNNRYSTWGGVSRLVYYPENYIDPTQRIGQTRMMDELLENISQSKLSRDTVEDAFKTYLTRFETVADLKVVSAYHDNVNSNTGLTWFVGQTRENLPEYYWRNVDISRMQAGELAANAWKEWTKIDTAVNPYKDAIRPVIFRERLHLIWVEKEEVAKNGTDPVETYDRFTLKLAFLRHDGSWSAPWSYDITTQVEAVTDKKPDTERLALAASGFQGEDTLLVFVYKTGKSYSDFGGSNKNVAGMTIYGDGSFKKMENTALSRYSQLKNTFDIIHTQGNDLVRKASYRFAQDFEVPASLNMGSAIGDDSLTVMENGNIPQITSKYSSDNLAITLHNAAFTVRYDGSGNVIRNKQISAMKLTGVDGKSQYGNAFIIANTVKHYGGYSDLGGPITVYNKTKNYIASVQGHLMNADYTRRLILTPVENNYYARLFEFPFSPNTILNTVFTVGSNKTSDFKKCSYAVDGNNSQGFQIFSSYQSSGWLDIDTGINNTDIKITVMAGSKTHTFTASDHIASLPANSFDAMPYTFKPLEIDASSLAFTNNIAPLDIVFETKAKDGRVLGKIKQTLSVKRVNYNPEDILFLRETHSGAQYMQLGVYRIRLNTLLASQLVSRANTGIDTILTMETQRLPEPPLGEGFFANFVLPKYDPAEHGDERWFKIHIGNVGGNTGRQPYYSGMLSDTSETSMTLFVPYAEGYYMHEGVRLGVGYQKITYDNTWESAFFYFDETKQQFVLINDADHDSGMTQQGIVKNIKKYKGFLNVSIATGYSAPMDFNSASALYYWELFYYTPMMCFQRLLQEKQFDEATQWINYVYNPAGYIVNGEIAPWIWNCRPLEETTSWNANPLDAIDPDAVAQNDPMHYKIATFMRLLDQLILRGDMAYRELTRDALNEAKMWYVRTLELLGDEPEDYGSQQWAAPSLSGAASQTVQAAYQQDLTMLGRGGVSKNLRTANSLVGLFLPEYNPALTDYWQTLRLRLFNLRHNLSIDGQPLSLAIYAEPTDPKALLTSMVQASQGGSAVLPGTLSLYRFPVMLERTRNLVAQLTQFGTSLLSMAEHDDADELTTLLLQQGMELATQSIRIQQRTVDEVDADIAVLAESRRSAQNRLEKYQQLYDEDINHGEQRAMSLLDAAAGQSLAGQVLSIAEGVADLVPNVFGLACGGSRWGAALRASASVMSLSATASQYSADKISRSEAYRRRRQEWEIQRDNADGEVKQMDAQLESLKIRREAAQMQVEYQETQQAHTQAQLELLQRKFTNKALYSWMRGKLSAIYYQFFDLTQSFCLMAQEALRRELTDNGVTFIRGGAWNGTTAGLMAGETLLLNLAEMEKVWLERDERALEVTRTVSLAQFYQALSSDNFNLTEKLTQFLREGKGNVGASGNELKLSNRQIEASVRLSDLKIFSDYPESLGNTRQLKQVSVTLPALVGPYEDIRAVLNYGGSIVMPRGCSAIALSHGVNDSGQFMLDFNDSRYLPFEGISVNDSGSLTLSFPDATDRQKALLESLSDIILHIRYTIRS

SEQ ID NO: 24 - protein, 2504 aa, Photorhabdus luminescens
MQNSLSSTIDTICQKLQLTCPAEIALYPFDTFREKTRGMVNWGEAKRIYEIAQAEQDRNLLHEKRIFAYANPLLKNAVRLGTRQMLGFIQGYSDLFGNRADNYAAPGSVASMFSPAAYLTELYREAKNLHDSSSIYYLDKRRPDLASLMLSQKNMDEEISTLALSNELCLAGIETKTGKSQDEVMDMLSTYRLSGETPYHHAYETVREIVHERDPGFRHLSQAPIVAAKLDPVTLLGISSHISPELYNLLIEEIPEKDEAALDTLYKTNFGDITTAQLMSPSYLARYYGVSPEDIAYVTTSLSHVGYSSDILVIPLVDGVGKMEVVRVTRTPSDNYTSQTNYIELYPQGGDNYLIKYNLSNSFGLDDFYLQYKDGSADWTEIAHNPYPDMVINQKYESQATIKRSDSDNILSIGLQRWHSGSYNFAAANFKIDQYSPKAFLLKMNKAIRLLKATGLSFATLERIVDSVNSTKSITVEVLNKVYRVKFYIDRYGISEETAAILANINISQQAVGNQLSQFEQLFNHPPLNGIRYEISEDNSKHLPNPDLNLKPDSTGDDQRKAVLKRAFQVNASELYQMLLITDRKEDGVIKNNLENLSDLYLVSLLAQIHNLTIAELNILLVICGYGDTNIYQITDDNLAKIVETLLWITQWLKTQKWTVTDLFLMTTATYSTTLTPEISNLTATLSSTLHGKESLIGEDLKRAMAPCFTSALHLTSQEVAYDLLLWIDQIQPAQITVDGFWEEVQTTPTSLKVITFAQVLAQLSLIYRRIGLSETELSLIVTQSSLLVAGKSILDHGLLTLMALEGFHTWVNGLGQHASLILAALKDGALTVTDVAQAMNKEESLLQMAANQVEKDLTKLTSWTQIDAILQWLQMSSALAVSPLDLAGMMALKYGIDHNYAAWQAAAAALMADHANQAQKKLDETFSKALCNYYINAVVDSAAGVRDRNGLYTYLLIDNQVSADVITSRIAEAIAGIQLYVNRALNRDEGQLASDVSTRQFFTDWERYNKRYSTWAGVSELVYYPENYVDPTQRIGQTKMMDALLQSINQSQLNADTVEDAFKTYLTSFEQVANLKVISAYHDNVNVDQGLTYFIGIDQAAPGTYYWRSVDHSKCENGKFAANAWGEWNKITCAVNPWKNIIRPVVYMSRLYLLWLEQQSKKSDDGKTTIYQYNLKLAHIRYDGSWNTPFTFDVTEKVKNYTSSTDAAESLGLYCTGYQGEDTLLVMFYSMQSSYSSYTDNNAPVTGLYIFADMSSDNMTNAQATNYWNNSYPQFDTVMADPDSDNKKVITRRVNNRYAEDYEIPSSVTSNSNYSWGDHSLTMLYGGSVPNITFESAAEDLRLSTNMALSIIHNGYAGTRRIQCNLMKQYASLGDKFIIYDSSFDDANRFNLVPLFKFGKDENSDDSICIYNENPSSEDKKWYFSSKDDNKTADYNGGTQCIDAGTSNKDFYYNLQEIEVISVTGGYWSSYKISNPININTGIDSAKVKVTVKAGGDDQIFTADNSTYVPQQPAPSFEEMIYQFNNLTIDCKNLNFIDNQAHIEIDFTATAQDGRFLGAETFIIPVTKKVLGTENVIALYSENNGVQYMQIGAYRTRLNTLFAQQLVSRANRGIDAVLSMETQNIQEPQLGAGTYVQLVLDKYDESIHGTNKSFAIEYVDIFKENDSFVIYQGELSETSQTVVKVFLSYFIEATGNKNHLWVRAKYQKETTDKILFDRTDEKDPHGWFLSDDHKTFSGLSSAQALKNDSEPMDFSGANALYFWELFYYTPMMMAHRLLQEQNFDAANHWFRYVWSPSGYIVDGKIAIYHWNVRPLEEDTSWNAQQLDSTDPDAVAQDDPMHYKVATFMATLDLLMARGDAAYRQLERDTLAEAKMWYTQALNLLGDEPQVMLSTTWANPTLGNAASKTTQQVRQQVLTQLRLNSRVKTPLLGTANSLTALFLPQENSKLKGYWRTLAQRMFNLRHNLSIDGQPLSLPLYAKPADPKALLSAAVSASQGGADLPKAPLTIHRFPQMLEGARGLVNQLIQFGSSLLGYSERQDAEAMSQLLQTQASELILTSIRMQDNQLAELDSEKTALQVSLAGVQQRFDSYSQLYEENINAGEQRALALRSESAIESQGAQISRMAGAGVDMAPNIFGLADGGMHYGAIAYAIADGIELSASAKMVDAEKVAQSEIYRRRRQEWKIQRDNAQAEINQLNAQLESLSIRREAAEMQKEYLKTQQAQAQAQLTFLRSKFSNQALYSWLRGRLSGIYFQFYDLAVSRCLMAEQSYQWEANDNSISFVKPGAWQGTYAGLLCGEALIQNLAQMEEAYLKWESRALEVERTVSLAVVYDSLEGNDRFNLAEQIPALLDKGEGTAGTKENGLSLANAILSASVKLSDLKLGTDYPDSIVGSNKVRRIKQISVSLPALVGPYQDVQAMLSYGGSTQLPKGCSALAVSHGTNDSGQFQLDFNDGKYLPFEGIALDDQGTLNLQFPNATDKQKAILQTMSDIILHIRYTIR

SEQ ID NO: 25 - protein, 2516 aa, Photorhabdus luminescens
MNESVKEIPDVLKSQCGFNCLTDISHSSFNEFRQQVSEHLSWSETHDLYHDAQQAQKDNRLYEARILKRANPQLQNAVHLAILAPNAELIGYNNQFSGRASQYVAPGTVSSMFSPAAYLTELYREARNLHASDSVYYLDTRRPDLKSMALSQQNMDIELSTLSLSNELLLESIKTESKLENYTKVMEMLSTFRPSGATPYHDAYENVREVIQLQDPGLEQLNASPAIAGLMHQASLLGINASISPELFNILTEEITEGNAEELYKKNFGNIEPASLAMPEYLKRYYNLSDEELSQFIGKASNFGQQEYSNNQLITPVVNSSDGTVKVYRITREYTTNAYQMDVELFPFGGENYRLDYKFKNFYNASYLSIKLNDKRELVRTEGAPQVNIEYSANITLNTADISQPFEIGLTRVLPSGSWAYAAAKFTVEEYNQYSFLLKLNKAIRLSRATELSPTILEGIVRSVNLQLDINTDVLGKVFLTKYYMQRYAIHAETALILCNAPISQRSYDNQPSQFDRLFNTPLLNGQYFSTGDEEIDLNSGSTGDWRKTILKRAFNIDDVSLFRLLKITDHDNKDGKIKNNLKNLSNLYIGKLLADIHQLTIDELDLLLIAVGEGKTNLSAISDKQLATLIRKLNTITSWLHTQKWSVFQLFIMTSTSYNKTLTPEIKNLLDTVYHGLQGFDKDKADLLHVMAPYIAATLQLSSENVAHSVLLWADKLQPGDGAMTAEKFWDWLNTKYTPGSSEAVETQEHIVQYCQALAQLEMVYHSTGINENAFRLFVTKPEMFGAATGAAPAHDALSLIMLTRFADWVNALGEKASSVLAAFEANSLTAEQLADAMNLDANLLLQASIQAQNHQHLPPVTPENAFSCWTSINTILQWVNVAQQLNVAPQGVSALVGLDYIQSMKETPTYAQWENAAGVLTAGLNSQQANTLHAFLDESRSAALSTYYIRQVAKAAAAIKSRDDLYQYLLIDNQVSAAIKTTRIAEAIASIQLYVNRALENVEENANSGVISRQFFIDWDKYNKRYSTWAGVSQLVYYPENYIDPTMRIGQTKMMDALLQSVSQSQLNADTVEDAFMSYLTSFEQVANLKVISAYHDNINNDQGLTYFIGLSETDAGEYYWRSVDHSKFNDGKFAANAWSEWHKIDCPINPYKSTIRPVIYKSRLYLLWLEQKEITKQTGNSKDGYQTETDYRYELKLAHIRYDGTWNTPITFDVNKKISELKLEKNRAPGLYCAGYQGEDTLLVMFYNQQDTLDSYKNASMQGLYIFADMASKDMTPEQSNVYRDNSYQQFDTNNVRRVNNRYAEDYEIPSSVSSRKDYGWGDYYLSMVYNGDIPTINYKAASSDLKIYISPKLRIIHNGYEGQKRNQCNLMNKYGKLGDKFIVYTSLGVNPNNSSNKLMFYPVYQYSGNTSGLNQGRLLFHRDTTYPSKVEAWIPGAKRSLTNQNAAIGDDYATDSLNKPDDLKQYIFMTDSKGTATDVSGPVEINTAISPAKVQIIVKAGGKEQTFTADKDVSIQPSPSFDEMNYQFNALEIDGSGLNFINNSASIDVTFTAFAEDGRKLGYESFSIPVTLKVSTDNALTLHHNENGAQYMQWQSYRTRLNTLFARQLVARATTGIDTILSMETQNIQEPQLGKGFYATFVIPPYNLSTHGDERWFKLYIKHVVDNNSHIIYSGQLTDTNINITLFIPLDDVPLNQDYHAKVYMTFKKSPSDGTWWGPHFVRDDKGIVTINPKSILTHFESVNVLNNISSEPMDFSGANSLYFWELFYYTPMLVAQRLLHEQNFDEANRWLKYVWSPSGYIVHGQIQNYQWNVRPLLEDTSWNSDPLDSVDPDAVAQHDPMHYKVSTFMRTLDLLIARGDHAYRQLERDTLNEAKMWYMQALHLLGDKPYLPLSTTWSDPRLDRAADITTQNAHDSAIVALRQNIPTPAPLSLRSANTLTDLFLPQINEVMMNYWQTLAQRVYNLRHNLSIDGQPLYLPIYATPADPKALLSAAVATSQGGGKLPESFMSLWRFPHMLENARGMVSQLTQFGSTLQNIIERQDAEALNALLQNQAAELILTNLSIQDKTIEELDAEKTVLEKSKAGAQSRFDSYGKLYDENINAGENQAMTLRASAAGLTTAVQASRLAGAAADLVPNIFGFAGGGSRWGAIAEATGYVMEFSANVMNTEADKISQSETYRRRRQEWEIQRNNAEAELKQIDAQLKSLAVRREAAVLQKTSLKTQQEQTQSQLAFLQRKFSNQALYNWLRGRLAAIYFQFYDLAVARCLMAEQAYRWELNDDSARFIKPGAWQGTYAGLLAGETLMLSLAQMEDAHLKRDKRALEVERTVSLAEVYAGLPKDNGPFSLAQEIDKLVSQGSGSAGSGNNNLAFGAGTDTKTSLQASVSFADLKIREDYPASLGKIRRIKQISVTLPALLGPYQDVQAILSYGDKAGLANGCEALAVSHGMNDSGQFQLDFNDGKFLPFEGIAIDQGTLTLSFPNASMPEKGKQATMLKTLNDIILHIRYTIK

SEQ ID NO: 26 - protein, 2499 aa, Photorhabdus luminescens
MNTLKSEYQQALGAGFNNLTDICHLSFDELRKKVKDKLSWSQTQSLYLEAQQVQKDNLLHEARILKRANPHLQSAVHLALTAPHADQQGYNSRFGNRASKYAAPGAISSMFSLAAYLTELYRQARNLHAEGSIYHLDTRRPDLKSLVLSQKNMNTEISTLSLSNNMLLNSIKTQPNLNSHAKVMEKLSTFRTSGSMPYHDAYESVRKIIQLQAPVFEQSSTLTDTPITKLMYQISLLGINASVSPELFTILTQKIKPATNADNTNELKKLYKKNFGEIKSIQMARAEYLKSYYNLTDKELNQFSKKIKQIDSLWNIGDEITQYHLLKFNKAINLSRSTELSPIILNSIAIDILKKTPPEDDSDNPFRDDPDYLESFQDLDLSDEPDIDEDVLREALRVKDYMQRYGIDAETALILCKAPISENPSHPDLSKLLADIHQLTIDELGVLLVAIDEGKTDLSQITHDNLAVLISKLYSVTNWLRTRKWSVYQLFVMTTDKYNKTLTPEINNLLDTVYNGLQNFYKDNLLKIKDNLLKAKESLPEDKDNLPKAEQYLLEAEKYLLAAEKYLLAAEKYLLEANKNPLEAKKALKEYEKNQEAYEKNLKEHEKYLLKAGENLPAIKENLLKIKENLPKAISPYIAAALQLPSENVALSVLAWADKLNSGKENKMTADSFWNWLRKKPIETQSKTTEATEATEATEATEATEATEKTTLIQQAVQYCQCLAQLALIYRSTGLSESTLRLFVTNPQIFGLTAKTTSTHNVLSLIMLTRFTDWVNSLGENASSVLTEFEKGTLTAELLANAMNLDKNLLEQASTQAQADFSNWPSIDNLLQWINISRQLNISPQGVSELAKILDIESSTNYAQWENVASILTAGLDTQKANTLHAFLGESRSTALSTYYIYSHNQKDREERKHTVIKDRDDLYQYLLIDNQVSAAIKTTEIAEAIASIQLYINRALKNMEGDTDTSVTSRLFFTNWDKYNKRYSTWAGITKLLYYPENYIDPTLRIGQTKMMDTLLQSISQSQLNTDTVEDAFKSYLTSFEQVANLEVISAYHDNINNDQGLTYFIGRSKTEVNQYYWRSVDHNKFSEGKFPANAWSEWHKIDCPINPYEDTIRPVVYQSRLYIIWLEQKKVTNRAEGEAIKQGSKTTTSYHYELKLAHIRYDGTWNTPITFDVDEKISGLNLELNKALGLYCASYQGKDKLLVMFYKKQEQLNNYTEKTGNTYTAPIKGLYITSNMSPEEMTPESYRLNAHKQFDTNNVVRVNNRYAESYEIPSSVNSNNGYDWGEGYLSMVYGGSILITRDPSDNSKIQISPKLRIIHNGYEGRQRNQCNLMKKYGKLGDKFIIYTTLGINPNNLSNKKLIYPVYQYEGNESKLSQGRLLFYRDSTTNFTRAWFPNLSSDSKEMSITTGGNISGNYGYIDNKHSDNKPFEEYFYMDDHGGIDTDVSEPIFINTKIQPSNVKIIVKTVKDDGKLDSKPYIAEDKVSVKPTPNFEEMCYQFNNLDQIDVSTLVFKNNEASIDITFTASADAFESGKEQRNLGEEHFSIRIIKKANVNDVLTLHHDPSGAQYMQWGAYRTRLNTLFARKLISRANAGIDTILSMETQNIQEPQLGKGFYVNFTLPKYDQNTHGNERQFKIHIGNIAGDNTMRPYYQGILADTETSVVLFVPYEKQSYTNEGVRLGVEYKKVSYLGVWEPAFFYFNEIQQKFILINDADHNSAMTQSGEKTGIKKYKGFLDVSILIDHQHTEPMDFNGANSLYFWELFYYTPMLIAQRLLHEQNFDEANRWLKYVWNPSGHIANGQKQHPHNWNVRPLQEDTSWNDDPLDTFDPDAIAQHDPMHYKVATFMCALDLLIEQGDYAYRQLERDTLAEAKMWYMQALHLLGDKPHLLLSSTWSDPELKEAADLEKQQAHAKAIADLRQGQPKDGSNTDLFLPQVNEVMLSYWQKLEQRLYNLRHNLSIDGQPLHLPIFATPADPKALLSAAVASSQGGSNLPSEFISVWRFPHMLENARSMVSQLTQFGSTLQNIIERQDAEALNTLLQNQAAELILTNLSIQDKTIEELDVEKTVLEKTRAGAKSRFDSYSKFYDEDINAGEKQAMALRASVAGISTALQASHLAGAALDLAPNIFGFADGGSHWGAIAQATSNVMEFSASVMSTEADKISQSEAYRRRRQEWKIQRNNADAELKQIDAQLQSLVVRREAAVLQKTSLKTQQEQTHAQLTFLQHKFSNQALYNWLRGRLSAIYFQFYDLAVARCLMAEMAYRWETNDAAARFIKPGAWQGTHAGLLAGETLMLNLAQMEDAHLKQEQRVLEVERTVSLAEVYKEKGQFSLTKKIAELVNKKPDTTSSRNNTLNFGEGNAKTSLQASISLADLQIRHDYPENSGAGNVRRIKQISVTLPALLGPYQDVQAILSYGGDATGLAKGCKALAVSHGMNDSGQFQLDFNDGKFLPFEGIEIDKGTLTLSFPNATEKQKTMLESISDIILHIRYTIRQ

SEQ ID NO: 27 - protein, 2381 aa, Photorhabdus luminescens
MNSYVKEIPDVLQSQYGINCLTDICHYSFNEFRQQVSDHLSWSETNRLYRDAQQEQKENQLYEARILKRANPQLQNAVHLGITLPHAELRGYNSEFGGRASQYVAPGSVSSMFSPAAYLTELYREARNLHASDSVYHLDERRPDLQSMTLSQQNMDTELSTLSLSNEILLKGIKANQSNLDSDTKVMEMLSTFRPSGTIPYHDAYENVRKAIQLQDPKLEQFQKSPAVAGLMHQASLLGINNSISPELFNILTEEITEANAEAIYKQNFGDIDPACLAMPEYLKSYYNFSDEELSQFIRKYPDNELNTQKIHLLKINKIILLSQAVNLPFLKLDEIIPEQNITPTVLGKIFLVKYYMQKYNIGTETALILCNDSISQYSYSNQPSQFDRLFNTSPLNGQYFVIEDTNIDLSLNSTDNWHKAVLKRAFNVDDISLYRLLHIANHNNTDGKIANNIKNLSNLYMTKLLADIHQLTIDELYLLLITIGEDKINLYDIDDKELEKLINRLDTLSNWLHTQKWSIYQLFLMTTTNYDKTLTPEIQNLLDTVYNGLQNFDKNKTKLLAAIAPYIAATLQLPSENVAHSILLWADKIKPSENKITAEKFWIWLQNRDTTELSKPPEMQEQIIQYCHCLAQLTMIYRSSGINENAFRLFIEKPTIFGIPDEPNKATPAHNAPTLIILTRFANWVNSLGEKASPILTAFENKTLTAEKLANAMNLDANLLEQASIQAQNYKQVTKENTFSNWQSIDIILQWTNIASNLNISPQGISPLIALDYIKPAQKTPTYAQWENAAIALTAGLDTQQTHTLHVFLDESRSTALSNYYIGKVANRAASIKSRDDLYQYLLIDNQVSAEIKTTRIAEAIASIQLYVNRALENIEIHAVSDVITRQFFIDWDKYNKRYSTWAGVSQLVYYPENYIDPTMRIGQTKMMDTLLQSVSQSQLNADTVEDAFKSYLTSFEQVANLEVISAYHDNVNNDQGLTYFIGNSKTEVNQYYWRSVDHSKFNDGKFAANAWSEWHKIDCAINPYQSTIRPVIYKSRLYLIWLEQKETAKQKEDNKVTTDYHYELKLAHIRYDGTWNVPITFDVDEKILALELTKSQAPGLYCAGYQGEDTLLIMFYRKKEKLDDYKTAPMQGFYIFSDMSSKDMTNEQCNSYRDNGYTHFDTNSDTNSVIRINNRYAEDYEIPSLINHSNSHDWGEYNLSQVYGGNIVINYKVTSNDLKIYISPKLRIIHDGKEGRERIQSNLIKKYGKLGDKFIIYTSLGINPNNSSNRFMFYPVYQYNGNTSGLAQGRLLFHRDTSYSSKVAAWIPGAGRSLINENANIGDDCAEDSVNKPDDLKQYIYMTDSKGTATDVSGPVDINTAISSEKVQITIKAGKEYSLTANKDVSVQPSPSFEEMCYQFNALEIDGSNLNFTNNSASIDVTFTALADDGRKLGYEIFNIPVIQKVKTDNALTLFHDENGAQYMQWGAYRIRLNTLFARQLVERANTGIDTILSMETQNIQEPMMGIGAYIELILDKYNPDIHGTNKSFKIIYGDIFKAGDHFPIYQGALSDITQTTVKLFLPRVDNAYGNKNNLYVYAAYQKVETNFIRFVKEDNNKPATFDTTYKNGTFPGLASARVIQTVSEPMDFSGANSLYFWELFYYTPMMVAQRLLHEQNFDEANRWLKYVWSPSGYIVRGQIKNYHWNVRPLLENTSWNSDPLDSVDPDAVAQHDPMHYKVATFMRTLDLLMARGDHAYRQLERDTLNEAKMWYMQALHLLGNKPYLPLSSVWNDPRLDNAAATTTQKAHAYAITSLRQGTQTPALLLRSANTLTDLFLPQINDVMLSYWNKLELRLYNLRHNLSIDGQPLHLPIYATPADPKALLSAAVATSQGGGKLPESFISLWRFPHMLENARSMVTQLIQFGSTLQNIIERQDAESLNALLQNQAKELILTTLSIQDKTIEEIDAEKTVLEKSKAGAKSRFDNYSKLYDEDVNAGERQALDMRIASQSITSGLKGLHMAAAALEMVPNIYGFAVGGTRYGAIANAIAIGGGIAAEGLLIEAEKVSQSEIWRRRRQEWEIQRNNAEAEMKQIDAQLKSLTVRREAAVLQKTGLKTQQEQTQAQLAFLQRKFSNQALYNWLRGRLAAIYFQFYDLVVARCLMAEQAYRWETNDSSARFIKPGAWQGTYAGLLAGETLMLNLAQMEDAHLKQEQRALEVERTVSLAQVYQSLGEKSFALKDKIEALLQGDKETSAGNDGNQLKLTNNTLSATLTLQDLKLKDDYPEEMQLGKTRRIKQISVSLPALLGPYQDVQAVLSYGGDATGLAKGCKALAVSHGLNDNGQFQLDFNDGKFLPFEGIDINDKGTFTLSFPNAASKQKNILQMLTDIILHIRYTILE

SEQ ID NO: 28 - DNA, 4431 bp, Photorhabdus luminescens
atgcagaattcacaaacattcagtgttaccgagctgtcattacccaaaggcggcggcgctattaccggtatgggtgaagcattaacaccagccgggccggatggtatggccgccttatccctgccattacccatttccgccgggcgtggttacgcaccctcgctcactctgaattacaacagtggaaccggtaacagcccatttggtctcggttgggactgcggcgtcatggcaattcgtcgtcgcaccagtaccggcgtaccgaattacgatgaaaccgatacttttctggggccggaaggtgaagtgttggtcgtagcattaaatgaggcaggtcaagctgatatccgcagtgaatcctcattgcagggcatcaatttgggtgcgaccttcaccgttacctgttatcgctcccgcctagaaagccactttaaccggttggaatactggcaaccccaaacaaccggcgcaaccgatttctggctgatatacagccccgacggacaggtccatttactgggcaaaaatcctcaggcacgtatcagcaatccactcaatgttaaccaaacagcgcaatggctgttggaagcctcgatatcatcccacagcgaacagatttattatcaatatcgcgctgaagatgaagcaggttgtgaaaccgacgagctagcagcccaccccagcgcaaccgttcagcgctacctgcaaacagtacattacgggaacctgaccgccagcgacgtttttcctacactaaacggagatgacccacttaaatctggctggatgttctgtttagtatttgactacggtgagcgcaaaaacagcttatctgaaatgccgctgtttaaagccacaggcaattggctttgccgaaaagaccgtttttcccgttatgagtacggttttgaattgcgtactcgccgcttatgccgccaaatactgatgtttcaccgtctacaaaccctatctggtcaggcaaagggggatgatgaacctgcgctagtgtcgcgtctgatactggattatgacgaaaacgcgatggtcagtacgctcgtttctgtccgccgggtaggccatgaggacaacaacacggttaccgcgctgccaccactggaactggcctatcagccttttgagccagaacaaaccgcactctggcaatcaatggatgtactggcaaatttcaacaccattcagcgctggcaactgcttgacctgaaaggagaaggcgtgcccggcattctctatcaggatagaaatggctggtggtatcgatctgcccaacgtcaggccggggaagagatgaatgcggtcacctgggggaaaatgcaactccttcccatcacaccagctgtgcaggataacgcctcactgatggatattaacggtgacgggcaactggactgggtgattaccgggccggggctaaggggctatcacagccaacacccggatggcagttggacgcgttttacgccattacatgccctgccgatagaatattctcatcctcgcgctcaacttgccgatttaatgggagccgggctgtccgatttagtgctaattggtcccaaaagtgtgcgcttatatgtcaataaccgtgatggttttaccgaagggcgggatgtggtgcaatccggtgatatcaccctgccgctaccgggcgccgatgcccgtaagttagtggcatttagtgacgtactgggttcaggccaagcacatctggttgaagttagtgcaactcaagtcacctgctggccgaatctggggcatggccgttttggtcagccaatcgtattgccgggattcagccaatctgccgccagttttaatcctgatcgagttcatctggccgatttggatgggagcggccctgccgatttgatttatgttcatgctgaccgtctggatattttcagcaatgaaagtggcaacggttttgcaaaaccattcacactctcttttcctgacggcctgcgttttgatgatacctgccagttgcaagtagccgatgtacaagggttaggcgttgtcagcctgatcctaagcgtaccgcatatggcgccacatcattggcgctgcgatctgaccaacgcgaaaccgtggttactcagtgaaacgaacaacaatatgggggccaatcacaccttgcattaccgtagctctgtccagttctggctggatgaaaaagctgcggcattggctaccggacaaacaccggtctgttacctgcccttcccggtccataccctttggcaaacagaaaccgaggatgaaatcagcggcaataagttagtgaccacgttacgttatgctcacggcgcttgggatggacgtgaacgggaatttcgtggctttggttatgttgagcagacagacagccatcaactcgctcaaggcaatgcgccggaacgtacaccaccggcactcaccaaaagctggtatgccaccggattacctgcggtagataatgcgttatccgccgggtattggcgtggcgataagcaagctttcgccggttttacgccacgttttactctctggaaagagggcaaagatgttccactgacaccggaagatgaccataatctatactggttaaaccgggcgctaaaaggtcagccactgcgtagtgaactctacgggctggatggcagcgcacagcaacagatcccctatacagtgactgaatcccgtccacaggtgcgccaattacaagatggcgccaccgtttccccggtgctctgggcctcagtcgtggaaagccgtagttatcactacgaacgtattatcagtgatccccagtgcaatcaggatatcacgttgtccagtgacctattcgggcaaccactgaaacaggtttccgtacaatatccccgccgcaacaaaccaacaaccaatccgtatcccgataccctaccggatacgctgtttgccagcagttatgacgatcaacaacagctattgcgattaacctgccgacaatccagttggcaccatcttattggtaatgagctaagagtgttgggattaccggatggcacacgcagtgatgcctttacttacgatgccaaacaggtacctgtcgatggcttaaatctggaaaccctgtgtgctgaaaatagcctgattgccgatgataaacctcgcgaatacctcaatcagcaacgaacgttctataccgacgggaaaaaccaaacaccgctgaaaacaccgacacgacaagcgttaatcgcctttaccgaaacggcggtattaacggaatctctgttatccgcgtttgatggcggtattacgccagacgaattaccgggaatactgacacaggccggataccaacaagagccttatctgtttccacgcaccggcgaaaacaaagtttgggtagcgcgtcaaggctataccgattacgggacggaagcacaattttggcgtcctgtcgcacaacgtaacagcctgttaaccgggaaaatgacgttaaaatgggatactcactattgtgtcatcacccaaacccaagatgctgccggcctcaccgtctcagccaattatgactggcgttttctcacaccaacgcaactgactgacatcaacgataatgtgcatctcatcaccttggatgctctgggacgccctgtcacgcaacgtttctgggggatcgaaagcggtgtggcaacaggttactcttcatcagaagaaaaaccattctctccaccaaacgatatcgataccgctattaatctaaccggaccactccctgtcgcacagtgtctggtctatgcaccggacagttggatgccactattcagtcaagaaaccttcaacacattaacgcaggaagagcaggagacgctgcgtgattcacgtattatcacggaagattggcgtatttgcgcactgactcgccgccgttggctacaaagtcaaaagatcagtacaccattagttaaactgttaaccaacagcattggtttacctccccataaccttacgctgaccacagaccgttatgaccgcgactctgagcagcaaattcgccaacaagtcgcatttagtgatggttttggccgtctgctacaagcgtctgtacgacatgaggcaggcgaagcctggcaacgtaaccaagacggttctctggtgacaaaagtggagaataccaaaacgcgttgggcggtcacgggacgcaccgaatatgataataaagggcaaacgatacgcacttatcagccctatttcctcaacgactggcgatatgtcagtgatgacagcgccagaaaagaagcctatgcggatactcatatttatgatccaattgggcgagaaatccgggttattactgcaaaaggctggctgcgccaaagccaatatttcccgtggtttaccgtgagtgaggatgagaatgatacggccgctgatgcgctggtgtaa

SEQ ID NO: 29 - DNA, 4425 bp, Photorhabdus luminescens
atgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgtaa

SEQ ID NO: 30 - DNA, 4458 bp, Photorhabdus luminescens
atgcaggattcaccagaagtatcgattacaacgctgtcacttcccaaaggtggcggtgctatcaatggcatgggagaagcactgaatgctgccggccctgatggaatggcctccctatctctgccattacccctttcgaccggcagagggacggctcctggattatcgctgatttacagcaacagtgcaggtaatgggcctttcggcatcggctggcaatgcggtgttatgtccattagccgacgcacccaacatggcattccacaatacggtaatgacgacacgttcctatccccacaaggcgaggtcatgaatatcgccctgaatgaccaagggcaacctgatatccgtcaagacgttaaaacgctgcaaggcgttaccttgccaatttcctataccgtgacccgctatcaagcccgccagatcctggatttcagtaaaatcgaatactggcaacctgcctccggtcaagaaggacgcgctttctggctgatatcgtcaccggacggccaactacacatcttagggaaaaccgcgcaggcttgtctggcaaatccgcaaaatgaccaacaaatcgcccagtggttgctggaagaaactgtgacgccagccggtgaacatgtcagctatcaatatcgagccgaagatgaagcccattgtgacgacaatgaaaaaaccgctcatcccaatgttaccgcacagcgctatctggtacaggtgaactacggcaacatcaaaccacaagccagcctgttcgtactggataacgcacctcccgcaccggaagagtggctgtttcatctggtctttgaccacggtgagcgcgatacctcacttcataccgtgccaacatgggatgcaggtacagcgcaatggtctgtacgcccggatatcttctctcgctatgaatatggttttgaagtgcgtactcgccgcttatgtcaacaagtgctgatgtttcaccgcaccgcgctcatggccggagaagccagtaccaatgacgccccggaactggttggacgcttaatactggaatatgacaaaaacgccagcgtcaccacgttgattaccatccgtcaattaagccatgaatcggacggcagcccagtcacccagccaccactagaactagcctggcaacggtttgatctggagaaaatgccgacatggcaacgctttgacgcactagataattttaactcgcagcaacgttatcaactggttgatctgcggggagaagggttgccaggtatgctgtatcaagatcgaggcgcttggtggtataaagctccgcaacgtcaggaagacggagacagcaatgccgtcacttacgacaaaatcgccccactgcctaccctacccaatttgcaggataatgcctcattgatggatatcaacggagacggccaactggattgggttgttaccgcctccggtattcgcggataccatagtcagcaacccgatggaaagtggacgcactttacgccaatcaatgccttgcccgtggaatattttcatccaagcatccagttcgctgaccttaccggggcaggcttatctgatttagtgttgatcgggccgaaaagcgtgcgtctatatgccaaccagcgaaacggctggcgtaaaggagaagatgtcccccaatccacaggtatcaccctgcctgtcacagggaccgatgcccgcaaactggtggctttcagtgatatgctcggttccggtcaacaacatctggtggaaatcaaggctaatcgcgtcacctgttggccgaatctagggcatggccgtttcggtcaaccactaactctgtcaggatttagccagcccgaaaatagcttcaatcccgaacggctgtttctggcggatatcgacggctccggcaccaccgaccttatctatgcgcaatccggctctttgctcatttatctcaaccaaagtggtaatcagtttgatgccccgttgacattagcgttgccagaaggcgtacaatttgacaacacttgccaacttcaagtcgccgatattcagggattagggatagccagcttgattctgactgtgccacatatcgcgccacatcactggcgttgtgacctgtcactgaccaaaccctggttgttgaatgtaatgaacaataaccggggcgcacatcacacgctacattatcgtagttccgcgcaattctggttggatgaaaaattacagctcaccaaagcaggcaaatctccggcttgttatctgccgtttccaatgcatttgctatggtataccgaaattcaggatgaaatcagcggcaaccggctcaccagtgaagtcaactacagccacggcgtctgggatggtaaagagcgggaattcagaggatttggctgcatcaaacagacagataccacaacgttttctcacggcaccgcccccgaacaggcggcaccgtcgctgagtattagctggtttgccaccggcatggatgaagtagacagccaattagctacggaatattggcaggcagacacgcaagcttatagcggatttgaaacccgttataccgtctgggatcacaccaaccagacagaccaagcatttacccccaatgagacacaacgtaactggctgacgcgagcgcttaaaggccaactgctacgcactgagctctacggtctggacggaacagataagcaaacagtgccttataccgtcagtgaatcgcgctatcaggtacgctctattcccgtaaataaagaaactgaattatctgcctgggtgactgctattgaaaatcgcagctaccactatgaacgtatcatcactgacccacagttcagccagagtatcaagttgcaacacgatatctttggtcaatcactgcaaagtgtcgatattgcctggccgcgccgcgaaaaaccagcagtgaatccctacccgcctaccctgccggaaacgctatttgacagcagctatgatgatcaacaacaactattacgtctggtgagacaaaaaaatagctggcatcacctgactgatggggaaaactggcgattaggtttaccgaatgcacaacgccgtgatgtttatacttatgaccggagcaaaattccaaccgaagggatttcccttgaaatcttgctgaaagatgatggcctgctagcagatgaaaaagcggccgtttatctgggacaacaacagacgttttacaccgccggtcaagcggaagtcactctagaaaaacccacgttacaagcactggtcgcgttccaagaaaccgccatgatggacgatacctcattacaggcgtatgaaggcgtgattgaagagcaagagttgaataccgcgctgacacaggccggttatcagcaagtcgcgcggttgtttaataccagatcagaaagcccggtatgggcggcacggcaaggttataccgattacggtgacgccgcacagttctggcggcctcaggctcagcgtaactcgttgctgacagggaaaaccacactgacctgggatacccatcattgtgtaataatacagactcaagatgccgctggattaacgacgcaagcccattacgattatcgtttccttacaccggtacaactgacagatattaatgataatcaacatattgtgactctggacgcgctaggtcgcgtaaccaccagccggttctggggcacagaggcaggacaagccgcaggctattccaaccagcccttcacaccaccggactccgtagataaagcgctggcattaaccggcgcactccctgttgcccaatgtttagtctatgccgttgatagctggatgccgtcgttatctttgtctcagctttctcagtcacaagaagaggcagaagcgctatgggcgcaactgcgtgccgctcatatgattaccgaagatgggaaagtgtgtgcgttaagcgggaaacgaggaacaagccatcagaacctgacgattcaacttatttcgctattggcaagtattccccgtttaccgccacatgtactggggatcaccactgatcgctatgatagcgatccgcaacagcagcaccaacagacggtgagctttagtgacggttttggccggttactccagagttcagctcgtcatgagtcaggtgatgcctggcaacgtaaagaggatggcgggctggtcgtggatgcaaatggcgttctggtcagtgcccctacagacacccgatgggccgtttccggtcgcacagaatatgacgacaaaggccaacctgtgcgtacttatcaaccctattttctaaatgactggcgttacgttagtgatgacagcgcacgagatgacctgtttgccgatacccacctttatgatccattgggacgggaatacaaagtcatcactgctaagaaatatttgcgagaaaagctgtacaccccgtggtttattgtcagtgaggatgaaaacgatacagcatcaagaaccccatag

SEQ ID NO: 31 - DNA, 4479 bp, Xenorhabdus nematophilus
atgcagggttcaacacctttgaaacttgaaataccgtcattgccctctgggggcggatcactaaaaggaatgggagaagcactcaatgccgtcggagcggaagggggagcgtcattttcactgcccttgccgatctctgtcgggcgtggtctggtgccggtgctatcactgaattacagcagtactgccggcaatgggtcattcgggatggggtggcaatgtggggttggttttatcagcctgcgtaccgccaagggcgttccgcactatacgggacaagatgagtatctcgggccggatggggaagtgttgagtattgtgccggacagccaagggcaaccagagcaacgcaccgcaacctcactgttggggacggttctgacacagccgcatactgttacccgctatcagtcccgcgtggcagaaaaaatcgttcgtttagaacactggcagccacagcagagacgtgaggaagagacgtctttttgggtactttttactgcggatggtttagtgcacctattcggtaagcatcaccatgcacgtattgctgacccgcaggatgaaaccagaattgcccgctggctgatggaggaaaccgtcacgcataccggggaacatatttactatcactatcgggcagaagacgatcttgactgtgatgagcatgaacttgctcagcattcaggtgttacggcccagcgttatctggcaaaagtcagctatggcaatactcagccggaaaccgcttttttcgcggtaaaatcaggtattcctgctgataatgactggctgtttcatctggtatttgattacggtgagcgctcatcttcgctgaactctgtacccgaattcaatgtgtcagaaaacaatgtgtctgaaaacaatgtgcctgaaaaatggcgttgtcgtccggacagtttctcccgctatgaatatgggtttgaaattcgaacccgtcgcttgtgtcgccaagttctgatgtttcatcagctgaaagcgctggcaggggaaaaggttgcagaagaaacaccggcgctggtttcccgtcttattctggattatgacctgaacaacaaggtttccttgctgcaaacggcccgcagactggcccatgaaacggacggtacgccagtgatgatgtccccgctggaaatggattatcaacgtgttaatcatggcgtgaatctgaactggcagtccatgccgcagttagaaaaaatgaacacgttgcagccataccaattggttgatttatatggagaaggaatttccggcgtactttatcaggatactcagaaagcctggtggtaccgtgctccggtacgggatatcactgccgaaggaacgaatgcggttacctatgaggaggccaaaccactgccacatattccggcacaacaggaaagcgcgatgttgttggacatcaatggtgacgggcgtctggattgggtgattacggcatcagggttacggggctaccacaccatgtcaccggaaggtgaatggacaccctttattccattatccgctgtgccaatggaatatttccatccgcaggcaaaactggctgatattgatggggctgggctgcctgacttagcgcttatcgggccaaatagtgtacgtgtctggtcaaataatcgggcaggatgggatcgcgctcaggatgtgattcatttgtcagatatgccactgccggttcccggcagaaatgagcgtcatcttgtcgcattcagtgatatgacaggctccgggcaatcacatctggtggaagtaacggcagatagcgtgcgctactggccgaacctggggcatggaaaatttggtgagcctctgatgatgacaggcttccagattagcggggaaacgtttaaccccgacagactgtatatggtagacatagatggctcaggcaccaccgattttatttatgcccgcaatacttaccttgaactctatgccaatgaaagcggcaatcattttgctgaacctcagcgtattgatctgccggatggggtacgttttgatgatacttgtcggttacaaatagcggatacacaaggattagggactgccagcattattttgacgatcccccatatgaaggtgcagcactggcgattggatatgaccatattcaagccttggctgctgaatgccgtcaataacaatatgggaacagaaaccacgctgtattatcgcagctctgcccagttctggctggatgagaaattacaggcttctgaatccgggatgacggtggtcagctacttaccgttcccggtgcatgtgttgtggcgcacggaagtgctggatgaaatttccggtaaccgattgaccagccattatcattactcacatggtgcctgggatggtctggaacgggagtttcgtggttttgggcgggtgacacaaactgatattgattcacgggcgagtgcgacacaggggacacatgctgaaccaccggcaccttcgcgcacggttaattggtacggcactggcgtacgggaagtcgatattcttctgcccacggaatattggcagggggatcaacaggcatttccccattttaccccacgctttacccgttatgacgaaaaatccggtggtgatatgacggtcacgccgagcgaacaggaagaatactggttacatcgagccttaaaaggacaacgtttacgcagtgagctgtatggggatgatgattctatactggccggtacgccttattcagtggatgaatcccgcacccaagtacgtttgttaccggtgatggtatcggacgtgcctgcggtactggtttcggtggccgaatcccgccaataccgatatgaacgggttgctaccgatccacagtgcagccaaaagatcgtccttaaatctgatgcgttaggatttccgcaggacaatcttgagattgcctattcgagacgtccacagcctgagttctcgccttatccggataccctgcccgaaacacttttcaccagcagtttcgacgaacagcagatgttccttcgtctgacacgccagcgttcttcttatcatcatctgaatcatgatgataatacgtggatcacagggcttatggatacctcacgcagtgacgcacgtatttatcaagccgataaagtgccggacggtggattttcccttgaatggttttctgccacaggtgcaggagcattgttgttgcctgatgccgcagccgattatctgggacatcagcgtgtagcatataccggtccagaagaacaacccgctattcctccgctggtggcatacattgaaaccgcagagtttgatgaacgatcgttggcggcttttgaggaggtgatggatgagcaggagctgacaaaacagctgaatgatgcgggctggaatacggcaaaagtgccgttcagtgaaaagacagatttccatgtctgggtgggacaaaaggaatttacagaatatgccggtgcagacggattctatcggccattggtgcaacgggaaaccaagcttacaggtaaaacgacagtcacgtgggatagccattactgtgttatcaccgcaacagaggatgcggctggcctgcgtatgcaagcgcattacgattatcgatttatggttgcggataacaccacagatgtcaatgataactatcacaccgtgacgtttgatgcactggggagggtaaccagcttccgtttctgggggactgaaaacggtgaaaaacaaggatatacccctgcggaaaatgaaactgtcccctttattgtccccacaacggtggatgatgctctggcattgaaacccggtatacctgttgcagggctgatggtttatgcccctctgagctggatggttcaggccagcttttctaatgatggggagctttatggagagctgaaaccggctgggatcatcactgaagatggttatctcctgtcgcttgcttttcgccgctggcaacaaaataaccctgccgctgccatgccaaagcaagtcaattcacagaacccaccccatgtactgagtgtgatcaccgaccgctatgatgccgatccggaacaacaattacgtcaaacgtttacgtttagtgatggttttgggcgaaccttacaaacagccgtacgccatgaaagtggtgaagcctgggtacgtgatgagtatggagccattgtggctgaaaatcatggcgcgcctgaaacggcgatgacagatttccgttgggcagtttccggacgtacagaatatgacggaaaaggccaagccctgcgtaagtatcaaccgtatttcctgaatagttggcagtacgtcagtgatgacagtgcccggcaggatatatatgccgatacccattactatgatccgttggggcgtgaatatcaggttatcacggccaaaggcgggtttcgtcgatccttattcactccctggtttgtggtgaatgaagatgaaaatgacactgccggtgaaatgacagca

SEQ ID NO: 32 - DNA, 4521 bp, Xenorhabdus bovienii
atgaaacaagattcacaggacatgacagtaacacagctgtccctgcccaaagggggcggtgcgatcagtggcatgggtgacactatcagcaatgcagggccggatgggatggcttcgctttccgtgcctttgcctatctctgccggtcgggggggcgcaccgaatttatccctgaactacagtagcggagcaggaaacgggtcatttggtattggctggcaatccagtaccatggctatcagccgtcgtactcaacatggcgtaccgcaatatcacggcgaagatacttttttatgtccgatgggagaagtgatggcggttgccgtcaatcagagcgggcaacccgatgtgcgtaaaaccgataaactattaggcgggcaactgcctgttacttataccgttacgcgtcatcagcccagaaatattcagcacttcagcaaacttgaatactggcagcccccaacggatgtggaaaccacgcctttttggttaatgtattcacccgatggacaaattcacattttcggaaaaactgagcaggctcagatcgctaacccggcagaggtttcacagattgcccaatggcttttggaagaaaccgtaacaccagcgggagaacacatttattaccagtatcgggcagaagacgatatcggttgtgatgacagcgaaaaaaatgcccaccctaatgccagtgctcaacgttatttgactcaggtgaactacggcaatattacacctgaatccagcctgcttgtgctgaagaatacgccaccggcggataacgaatggctattccatttggtttttgattatggtgaacgagcgcaggaaataaacacggttcctcctttcaaagcaccttcaaacaactggaaaatacggccagaccgtttctcccgctttgaatatggttttgaggtgcgaacccgccgcctgtgtcaacaaattctgatgttccatcgcctgaaatcccttgcaggagaacagattgacggagaagaaatccctgccttggttgcccgtctgcttctcagttatgacctgaacgacagcgtgacaacccttaccgccattcggcaaatggcgtatgaaactgacgcaaccttaatcgctttaccgccactggagtttgactatcagccctttgaggcaaaagtcacgcagaaatggcaggaaatgcctcaattggccggattgaatgcccaacaaccttaccaactcgtcgatctctatggtgaaggtatctccggcatcttgtatcaggacagacccggagcatggtggtatcaggcaccgatccgtcagaaaaacgttgaagatattaacgctgtcacctatagcccaataaaccccttacctaagatccccagccagcaggacagagcaacgttgatggatatcgacggtgatggacatctggattgggtgatcgctggcgcaggtattcaggggcggtacagtatgcagccgaatggagagtggacacactttattcccatttctgcactgccaacagaatattttcatccacaggcacaactggcggatctggtgggggccgggttatctgatttagcgctgattggccccagaagtgtgcgtttatatgccaacgaccgaggaaactggaaagcgggtattaatgttatgccacctgatggtgtgaatttgccgatatttggtggtgatgccagcagtctggtcgcattttctgacatgttgggatcgggacagcagcatttggtggaaattgccgctcagagcgtcaaatgctggccgaatctaggacatggccgttttggtgcggctattttgctgccggggtttagccagccgaatggaacattcaatgctaaccaagtttttctggcagatatcgatggttccggcaccgccgacatcatctatgcacacagtacgtatctggatatttacctgaacgaaagcggcaaccgtttcagtgcacccgttcggcttaatttgccggaaggggtgatgtttgacaatacctgtcagttacaggtgtcggatattcaaggattgggcgctgccagcattgtactgaccgtacctcatatgacaccgcgccattggcgttatgattttactcacaataaaccttggctgctcaatgtcatcaacaacaatcgtggcgcagaaaccacgttgttttaccgtagttctgcccaattctggctggatgaaaaaagtcagatcgaagagctgggaaaatttgcagcgagttatctgcctttccccatacatttgttgtggcgcaatgaggcgctggatgaaattactggtaatcgactgactaaggtcatgaattatgcccacggtgcatgggatggcagagagagagaattttgcggatttggccgtgtaacgcaaattgataccgacgaatttgccaagggaaccacagagaaagcgccggatgaaaatatctatccttcccgtagcataagctggtttgccacgggtttaccagaagtggattctcaacttccggcagaatactggcgtggtgacgatcaggcatttgccggctttacaccgcgcttcactcgttatgaaaaaggtaatgcggggcaagaggggcaggataccccgattaaagaaccgaccgaaacagaagcgtattggcttaaccgcgccatgaaaggccaattactgcgcagtgaagtctatggtgacgacaaaacagaaaaagctaaaattccgtacaccgtcacagaagctcgctgtcaggtcagattaattcccagcaatgacgaagccgcgccgtcgtcttggacgtcgatcattgaaaaccgcagttatcactatgagcgtatcgtcgtcgatccgagttgcaaacaacaggtcgtgctcaaggcggatgaatatggcttcccactggcaaaagtagatatcgcctatccacggcgcaataaaccggcacagaacccttatccggattcgttaccggatactctgttcgccgatagctatgacgaccagcaaaaacagttatatctgacaaaacagcagcagagctattaccacctgacccagcaggatgattgggttctgggtttgacggatagccgatacagcgaagtttatcattatgcgcaaactgacgctcaaagtgacatccccaaggcagggctgatattggaagacctgctgaaagttgacggcctgataggtaaagacaagacttttatctatttagggcagcagcgagtggcttatgtgggaggagatgcagaaaaaccgacacgtcaggtgcgggtggcttatacagaaaccgctgcttttgatgacaatgcgctgcacgcctttgatggcgtgattgcccctgatgaactgacgcaacagttgctggcgggtggatacctgctcgtgccgcagatttctgatgtggcaggcagtagtgaaaaggtatgggtagctcggcagggatacaccgaatacggcagtgctgctcaattctaccggccactcatccagcgcaaaagcttgctgaccggaaaatatacccttagttgggatacgcactattgtgtggtggtaaaaaccgaagatggtgcgggaatgaccacgcaagcgaagtacgattaccgcttcctgcttccggcgcaattgacagatatcaatgacaaccagcacatcgtgacatttaatgcattggggcaggtgacttccagccgtttctggggcacagaaaatggcaaaataagcggttactcgacgccggagagtaaaccgttcacagtacccgataccgtcgaaaaagcccttgccttgcaaccgacgatcccggtttcacagtgcaacatttatgtgccggatagttggatgcggcttctgccccaacagtctctgactggccagctaaaagagggggaaactttgtggaacgcattacaccgggcgggtgtagtaacggaagacggtttgatctgtgaactggcctatcgtcgttggatcaaacgtcaggcaacgtcttcaatgatggccgtgacattacagcaaatcttggctcagactccacgacaacctccgcatgccatgacgatcacgacagatcgttatgacagcgattctcagcagcaacttcggcagtcgatagtattgagtgatggttttggtcgcgtattgcaaagcgcccagcgtcatgaagcaggagaggcatggcagcgtgcagaagatggttctttggttgtcgataataccggtaaacccgttgttgctaataccacaacgcgctgggcagtatccggtcgcacagaatacgacggcaaagggcaggcgatcagagcttacctgccttattatctcaatgattggcgctatgtcagtgatgacagcgcccgggatgacctgtacgccgatacccatttttacgatcctctggggcgtgaatatcaggtaaaaaccgcgaaaggattttggcgtgaaaacatgtttatgccgtggtttgtcgtcaatgaagatgaaaatgacacagcagcacgtttaacatcttaa

SEQ ID NO: 33 - DNA, 4335 bp, Paenibacillus strain DAS1529
atgccacaatctagcaatgccgatatcaagctattgtcgccatcgctgccaaagggcggcggttccatgaagggaatcgaagaaaacatcgcggctcccggctccgacggcatggcacgttgtaatgtgccgctgccggtaacctccggccgctatattactcctgatataagcctgtcctatgcgagcggccacggcaacggcgcttatggaatgggctggacgatgggagtgatgagcattagccggagaacaagccgagggacccccagttatacatccgaagaccagttccttggtccggatggggaggtgcttgttccggaaagcaacgaacaaggggagatcattacccgccacaccgatacggcccaagggataccgttaggcgagacgtttacggttacacgctattttccccggatcgagagcgcttttcatttgctggaatactgggaagcgcaagcaggaagcgcaacagcgtcgttttggcttattcactctgccgatggagtgctgcactgtctgggtaaaactgctcaggcgaggatagccgcccctgacgattccgccaagatcgcagaatggctagtggaggagtccgtctcccccttcggagagcatatttattaccaatacaaagaagaagacaatcaaggcgtgaatctggaggaagacaatcatcaatatggggcgaaccgctatctgaaatcgattcgctatggaaataaggttgcctctccttctctctatgtctggaagggggaaattccggcagacggccaatggctgtattccgttatcctggattatggcgagaacgatacctcagcggatgttcctcccctatacacgccccaaggggagtggctggtgcgcccggaccgtttttcccgctatgactacggatttgaggtccggacttgccgcttgtgccgccaggtcttgatgttccacgtctttaaggagcttggcggggagccggcgctggtgtggcggatgcagttggaatacgacgagaacccggcggcgtccatgctgagcgcggtccggcaattggcttatgaagcagatggggccattcgaagcttgccgccgctggaattcgattatactccatttggcatcgagacaacggccgattggcagccttttctgcctgtgcctgaatgggcggatgaagaacattatcagttggtcgatttgtacggagaaggcataccgggcttattatatcagaacaatgaccactggcattatcgttcgcccgcccggggcgacacaccggacgggatcgcctataacagctggcggccgcttcctcatatccccgtgaactcccggaacgggatgctgatggatctgaatggagacgggtatctggaatggttgcttgcggaacccggggttgcggggcgctatagcatgaacccggataagagctggtccggttttgtgccgctccaggcactgccaacggaattcttccatccgcaggcacagcttgccaatgttaccggatcgggtttaaccgacttggttatgatcggtccgaagagcgtccggttttatgccggagaagaagcgggcttcaagcgcgcatgtgaagtgtggcagcaagtgggcattactttgcctgtggaacgcgtggataaaaaggaactggtggcattcagcgatatgctgggatcgggtcagtctcatctggtgcgcatccggcatgatggcgttacatgctggcctaatctggggaacggcgtgttcggggcgccgttggcccttcacgggtttacggcatcggagcgggaattcaatccggaacgtgtatatcttgtggaccttgatggatccggcgcttccgatatcatttatgcttctcgtgacgctctactcatttaccgaaatctttccggcaatggctttgctgatccggtgcgggttccgctgcctgacggcgtgcggtttgataatctgtgccggctgctgcctgccgatatccgcgggttaggtgtggccagtctggtgctgcatgtaccttacatggccccccgcagttggaaattagatttctttgcggcgaagccgtatttattgcaaacggtcagcaacaatcttggagcttccagctcgttttggtaccgaagctccacccagtattggctggatgagaaacaggcggcctcatcggctgtctccgctttgcccttcccgataaacgtggtatcggatatgcacacggtggacgaaatcagcggccgcaccaggactcagaagtatacttaccgccatggcgtgtatgaccggaccgaaaaggaatttgccggattcggccgcattgacacatgggaagaggagcgggattccgaaggaaccctgagcgtcagcactccgcccgtgctgacgcggacctggtatcataccgggcaaaagcaggatgaggagcgtgccgtgcagcaatattggcaaggcgaccctgcggcttttcaggttaaacccgtccggcttactcgattcgatgcggcagcggcccaggatctgccgctagattctaataatgggcagcaagaatactggctgtaccgatcattacaagggatgccgctgcggactgagatttttgcgggagatgttggcgggtcgcctccttatcaggtagagagcttccgttatcaagtgcgcttggtgcagagcatcgattcggaatgtgttgccttgcccatgcagttggagcagcttacgtacaactatgagcaaatcgcctctgatccgcagtgttcacagcagatacagcaatggttcgacgaatacggcgtggcggcacagagtgtaacaatccaatatccgcgccgggcacagccggaggacaatccgtaccctcgcacgctgccggataccagctggagcagcagttatgattcgcagcaaatgctgctgcggttgaccaggcaaaggcaaaaagcgtaccaccttgcagatcctgaaggctggcgcttgaatattccccatcagacacgcctggatgccttcatttattctgctgacagcgtgcccgccgaaggaataagcgccgagctgctggaggtggacggcacgttacgatcttcggcgctggaacaggcttatggcggccagtcagagatcatctatgcgggcgggggcgaaccggatttgcgagccctggtccattacaccagaagcgcggttcttgatgaagactgtttacaagcctatgaaggcgtactgagcgatagccaattgaactcgcttcttgcctcttccggctatcaacgaagcgcaagaatattgggttcgggcgatgaagtggatatttttgtcgcggaacaaggatttacccgttatgcggatgaaccgaattttttccgtattctggggcaacaatcctctctcttgtccggggaacaagtattaacatgggatgataatttctgtgcggttacatccatcgaagacgcgcttggcaatcaaattcagattgcatatgattaccgctttgtggaggccatccagattaccgatacgaataataatgtgaatcaggtcgccctggatgctctcggccgggtcgtatacagccggacctggggcacggaggaagggataaagaccggcttccgcccggaggtggaattcgcgacgcccgagacaatggagcaggcgcttgccctggcatctcccttgccggttgcatcctgctgtgtatatgatgcgcatagctggatgggaacgataactcttgcacaactgtcagagcttgttccagatagtgaaaagcaatggtcgttcttgatagacaatcgcttgattatgccggacggcagaatcagatcccgcggtcgggatccatggtcgcttcaccggctattgccgcctgctgtgggcgaattgctgagcgaggcggaccgtaaaccgccgcatacggtaattttggcagcagatcgttacccggatgacccatcccagcaaattcaggcgagcatcgtgtttagcgatggctttgggcgtacgatacaaactgctaaaagagaagatacccgatgggcgattgcggaacgggtggactatgacggaaccggagccgtaatccgcagctttcagcctttttatcttgacgactggaattatgtgggcgaagaggctgtcagcagctctatgtacgcaacgatctattattatgatgctctggcacgacaattaaggatggtcaacgctaaaggatatgagaggagaactgctttttacccatggtttacagtaaacgaagatgaaaatgataccatggactcatcattatttgcttcaccgcctgcgcggtga

SEQ ID NO: 34 - DNA, 3132 bp, Photorhabdus luminescens
atgagtccgtctgagactactctttatactcaaaccccaacagtcagcgtgttagataatcgcggtctgtccattcgtgatattggttttcaccgtattgtaatcgggggggatactgacacccgcgtcacccgtcaccagtatgatgcccgtggacacctgaactacagtattgacccacgcttgtatgatgcaaagcaggctgataactcagtaaagcctaattttgtctggcagcatgatctggccggtcatgccctgcggacagagagtgtcgatgctggtcgtactgttgcattgaatgatattgaaggtcgttcggtaatgacaatgaatgcgaccggtgttcgtcagacccgtcgctatgaaggcaacaccttgcccggtcgcttgttatctgtgagcgagcaagttttcaaccaagagagtgctaaagtgacagagcgctttatctgggctgggaatacaacctcggagaaagagtataacctctccggtctgtgtatacgccactacgacacagcgggagtgacccggttgatgagtcagtcactggcgggcgccatgctatcccaatctcaccaattgctggcggaagggcaggaggctaactggagcggtgacgacgaaactgtctggcagggaatgctggcaagtgaggtctatacgacacaaagtaccactaatgccatcggggctttactgacccaaaccgatgcgaaaggcaatattcagcgtctggcttatgacattgccggtcagttaaaagggagttggttgacggtgaaaggccagagtgaacaggtgattgttaagtccctgagctggtcagccgcaggtcataaattgcgtgaagagcacggtaacggcgtggttacggagtacagttatgagccggaaactcaacgtctgataggtatcaccacccggcgtgccgaagggagtcaatcaggagccagagtattgcaggatctacgctataagtatgatccggtggggaatgttatcagtatccataatgatgccgaagctacccgcttttggcgtaatcagaaagtggagccggagaatcgctatgtttatgattctctgtatcagcttatgagtgcgacagggcgtgaaatggctaatatcggtcagcaaagcaaccaacttccctcacccgttatacctgttcctactgacgacagcacttataccaattaccttcgtacctatacttatgaccgtggcggtaatttggttcaaatccgacacagttcacccgcgactcaaaatagttacaccacagatatcaccgtttcaagccgcagtaaccgggcggtattgagtacattaacgacagatccaacccgagtggatgcgctatttgattccggcggtcatcagaagatgttaataccggggcaaaatctggattggaatattcggggtgaattgcaacgagtcacaccggtgagccgtgaaaatagcagtgacagtgaatggtatcgctatagcagtgatggcatgcggctgctaaaagtgagtgaacagcagacgggcaacagtactcaagtacaacgggtgacttatctgccgggattagagctacggacaactggggttgcagataaaacaaccgaagatttgcaggtgattacggtaggtgaagcgggtcgcgcacaggtaagggtattgcactgggaaagtggtaagccgacagatattgacaacaatcaggtgcgctacagctacgataatctgcttggctccagccagcttgaactggatagcgaagggcagattctcagtcaggaagagtattatccgtatggcggtacggcgatatgggcggcgagaaatcagacagaagccagctacaaatttattcgttactccggtaaagagcgggatgccactggattgtattattacggctaccgttattatcaaccttgggtgggtcgatggttgagtgctgatccggcgggaaccgtggatgggctgaatttgtaccgaatggtgaggaataaccccatcacattgactgaccatgacggattagcaccgtctccaaatagaaatcgaaatacattttggtttgcttcatttttgtttcgtaaacctgatgagggaatgtccgcgtcaatgagacggggacaaaaaattggcagagccattgccggcgggattgcgattggcggtcttgcggctaccattgccgctacggctggcgcggctatccccgtcattctgggggttgcggccgtaggcgcggggattggcgcgttgatgggatataacgtcggtagcctgctggaaaaaggcggggcattacttgctcgactcgtacaggggaaatcgacgttagtacagtcggcggctggcgcggctgccggagcgagttcagccgcggcttatggcgcacgggcacaaggtgtcggtgttgcatcagccgccggggcggtaacaggggctgtgggatcatggataaataatgctgatcgggggattggcggcgctattggggccgggagtgcggtaggcaccattgatactatgttagggactgcctctacccttacccatgaagtcggggcagcggcgggtggggcggcgggtgggatgatcaccggtacgcaagggagtactcgggcaggtatccatgccggtattggcacctattatggctcctggattggttttggtttagatgtcgctagtaaccccgccggacatttagcgaattacgcagtgggttatgccgctggtttgggtgctgaaatggctgtcaacagaataatgggtggtggatttttgagtaggctcttaggccgggttgtcagcccatatgccgccggtttagccagacaattagtacatttcagtgtcgccagacctgtctttgagccgatatttagtgttctcggcgggcttgtcggtggtattggaactggcctgcacagagtgatgggaagagagagttggatttccagagcgttaagtgctgccggtagtggtatagatcatgtcgctggcatgattggtaatcagatcagaggcagggtcttgaccacaaccgggatcgctaatgcgatagactatggcaccagtgctgtgggagccgcacgacgagttttttctttgtaa

SEQ ID NO: 35 - DNA, 2745 bp, Photorhabdus luminescens
atgagcagttacaattctgcaattgaccaaaagaccccctcgattaaggtattagataacaggaaattaaatgtacgtactttagaatatctacgcactcaagctgacgaaaacagtgatgaattaattacgttctatgagttcaatattccgggatttcaggtaaaaagcaccgatcctcgtaaaaataaaaaccagagcggcccaaatttcattcgtgtctttaatcttgccggtcaagttttacgtgaagaaagtgttgatgccggtcggactattaccctcaatgatattgaaagtcgcccggtgttgatcatcaatgcaaccggtgtccgccaaaaccatcgttatgaagataacacccttcccggtcgtctgctcgctatcaccgaacaagtacaggcaggagagaaaacgaccgaacgtcttatctgggccggcaatacgccgcaagaaaaagattacaacctcgccggtcagtgtgtccgccattacgataccgcgggacttactcaactcaatagcctttctctggctggcgtcgtgctatcacaatctcaacaactgcttaccgataaccaggatgccgactggacaggtgaagaccagagcctctggcaacaaaaactgagtagtgatgtctatatcacccaaagtaacactgatgccaccggggctttactgacccagaccgatgccaaaggcaacattcagcggctggcctatgatgtggccgggcagctaaaagggagttggttaacactcaaaggtcaggcggaacaggtgattatcaaatcgctaacctactccgccgccgggcaaaaattacgtgaagagcacggtaacgggattgtcactgaatacagctacgaaccggaaacccaacggcttatcggcattaccactcgccgtccatcagacgccaaggtgttgcaagacctacgctatcaatatgacccagtaggcaatgtcattaatatccgtaatgatgcggaagccactcgcttttggcgcaatcagaaagtagccccggagaatagctatacctacgattccctgtatcagcttatcagcgccaccgggcgcgaaatggccaatatcggtcagcaaaacaaccaacttccctcccctgcgctaccttctgacaacaatacctacactaactatactcgcagctacagctatgatcacagtggtaatctgacgcaaattcggcacagctcgccagctacccagaacaactacaccgtggctatcaccctctcaaaccgcagcaatcggggtgttctcagtacgctaaccaccgatccaaatcaagtggatacgttgtttgatgccggtggtcaccaaaccagtttattacccggacagacacttatctggacaccacgaggagagttaaagcaggttaataatggcccgggaaatgagtggtaccgctacgacagcaacggcatgagacaactgaaagtgagtgaacagccaacccagaatactacgcagcaacaacgggtaatctatttgccgggactggagctacgcacaacccagagcaacgccacaacaacggaagagttacacgttatcacactcggtgaagccggtcgcgcacaggtacgggtgttgcactgggagagcggtaagccagaagatgtcaacaataatcaactacgttacagctacgataatctgatcggctccagccagcttgaactggacaaccaaggacaaattatcagcgaggaagagtattatccatttggcgggacagcgctgtgggcagcaaacagccaaacagaagccagctataaaacgattcgctattccggcaaagaacgagatgccaccgggttgtattattacggttatcgttattaccaaccgtgggcgggcagatggttaagcgcggacccggcaggaaccattgatgggctgaatctataccgaatggtaagaaataatcctgtgagtttacaagatgaaaatggattagcgccagaaaaagggaaatataccaaagaggtaaatttctttgatgaattaaaattcaaattggcagccaaaagttcacatgttgtcaaatggaacgagaaagagagcagttatacaaaaaataaatcattgaaagtggttcgtgtcggtgattccgatccgtcgggttatttgctaagccacgaagagttactaaaaggtatagaaaaaagtcaaatcatatatagccgacttgaagaaaacagctccctttcagaaaaatcaaaaacgaatctttctttaggatctgaaatatccggttatatggcaagaaccatacaagatacgatatcagaatatgccgaagagcataaatatagaagtaatcaccctgatttttattcagaaaccgatttctttgcgttaatggataaaagtgaaaaaaatgattattccggtgaaagaaaaatttatgcggcaatggaggttaaggtttatcatgatttaaaaaataaacaatcagaattacatgtcaactatgcattggcccatccctatacgcaattgagtaatgaagaaagagcgctgttgcaagaaacagaacccgctattgcaatagatagagaatataatttcaaaggtgttggcaaattcctgacaatgaaagcaattaaaaaatcattgaaaggacataaaattaataggatatcaacagaggctattaatattcgctctgcggctatcgctgagaatttaggaatgcggagaacttca

SEQ ID NO: 36 - DNA, 2883 bp, Photorhabdus luminescens
atgaaaaacattgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataa

SEQ ID NO: 37 - DNA, 2850 bp, Photorhabdus luminescens
atgaaaaacattgacccaaaactttatcaacatacgcccaccgttaacgtctacgataaccgtggcctgaccattcgtaacatcgactttcaccgtgacgtcgcgggaggcgatacagatactcgtattacccgccaccaatatgatacccgaggacacttgagccaaagcattgatccacggctgtatgacgccaaacaaaccaataactcgacaaaccccaacttcctctggcaatacaatctcaccggcgacactttgcggacagaaagtgtcgatgccggccgtaccgtagccctcaatgatattgaaggccgtcaagtgttgattgtaaccgcaaccggcgccattcagacccgacaatatgaagccaataccctgcccggtcgtctattatccgtaagtgaacaagcccccggagaacagactccccgcgttactgagcattttatttgggctggtaatacacaggcggagaaagatcataatcttgccggccagtatgtgcgccactacgacacagcaggagtgacgcaactggaaagcctgtcattgacagaaaacatcttatctcaatcccgtcagttattagccgacggtcaggaagcagactggacaggtaacgatgaaaccctctggcagaccaaactcaatagcgaaacttacacgacacaaagcacctttgatgctaccggcgctttgctgacccaaaccgatgcaaaaggcaacatgcaacgtctggcttacaacgtggcaggacaattacaaggtagctggctgacattgaaaaaccaaagtgagcaagtcattgtcaaatccctgacctattccgccgcaggccagaaattgcgtgaagaacacggtaatggcgttatcactgaatacagctatgaaccggaaactctacgattgatcggtaccactactcgccgtcaatcagatagcaaggtgttacaagatctacgctatgaacatgatcctgtagggaatattattagtgtccgtaatgatgcagaagccacccgcttctggcgcaatcagaaaatagtccctgaaaatacctacacctacgattccctgtatcagcttatcagtgcaacaggacgtgagatggctaacatcggccagcaaagcaaccaacttccttcgccaatcatccctcttcctactgatgaaaactcatataccaactatactcgcagctataattacgatcgcggcggcaatttggttcaaatccggcacagttcccccgccgcccaaaataactacaccacagatatcaccgtttcgaatcgcagtaaccgggcagtgctgagttcgctaacctcagacccaacacaggtggaggcactgtttgatgccggcggacatcaaacaaaattgttaccggggcaagagctgagttggaatacacgaggtgaactaaaacaggtaacgccagtcagtcgcgagagcgccagcgatcgggaatggtatcgttacggcaacgacggcatgcgacggttaaaagtcagtgagcaacagactggcaacagcacgcagcagcaacgagtaacttatcttcccgatctggagctacgtacaacacaaaatgggactactacatcagaagacctgcatgctattaccgtgggagcagcaggccacgcacaagtgcgagttctacactgggaaactacgccaccagccggtatcaataacaatcagcttcgctatagctatgataatttgattggttccagtcaacttgaactggataacgcaggacaaattatcagtcaggaagagtattatccatttggcggcacagcattatgggcagcaagaaaccaaatagaagccagctacaaaatcctccgttactcaggtaaagaacgcgatgctaccgggctctattattacggctaccgctattatcagccgtgggttggtaggtggttaagcgccgatccggctggaacaatcgatggactgaatctataccggatggtgagaaataatccgtcaacactggttgatatttctgggcttgcacctacgaaatacaatattcccggatttgactttgatgtagaaatagatgagcaaaaaagatctaaattaaaaccaacgttgataagaatcaaagatgaatttttacattatggtcctgtagataagctgttagaagaaaaaaaacccggcctcaatgtaccagaggagctatttgatagaggtccatccgagaatggagtgtcaacattaactttcaaaaaagacctaccgataagttgtattagcaacacagaatatacccttgatatcttatacaacaaacatgagactaaaccattcccttacgaaaacgaagcaacagttggcgcagatctgggagtaataatgtccgtggagtttggaaataaatcaataggtaatgcctctgacgaagatttaaaagaagaacatctcccattaggaaaatccacaatggataaaacagacctgccagatttaaaacaagggctaatgatcgcggagaagataaaaagtggaaaaggggcatatccttttcattttggtgctgcaatagctgttgtatatggtgaggataaaaaagtagccgcttcaattctgacagatttatctgaacctaaaagagacgaaggcgagtatttgcaaagtacgagaaaggtaagcgcaatgtttatcacaaacgtcaatgaatttcgcggccatgattacccaaaaagtaaatatagtatcggattagttacagctgaaaaacgtcagccagtaataagcaaaaaacgtgcaaacccggaagaggccccttcatcatccagaaataaaaaattgcatgtacattaa

SEQ ID NO: 38 - DNA, 2817 bp, Photorhabdus luminescens
atggaaaacattgacccaaaactttatcaccatacgcctaccgtcagtgttcacgataaccgtggactagctatccgtaatattagttttcaccgcactaccgcagaagcaaataccgatacccgtattacccgccatcaatataatgccggcggatatttgaaccaaagcattgatcctcgcctgtatgacgccaaacagactaacaacgctgtacaaccgaattttatctggcgacataatttgaccggcaatatcctgcgaacagagagcgtcgatgccggtcggacgattaccctcaacgatattgaaggccgcccggtgttgaccatcaatgcagccggtgtccggcaaaaccatcgctacgaagataacaccctgcccggtcgcctgctcgctatcagcgaacaaggacaggcagaagagaaaacgaccgagcgccttatctgggccggcaatacgccgcaagaaaaagaccacaaccttgccggtcagtgcgtccgccattacgataccgcaggactcactcaactcaacagccttgccctgaccggcgccgttctatcacaatctcaacaactgcttaccgataaccaggatgccgactggacaggtgaagaccagagcctctggcaacaaaaactgagtagtgatgtctatatcacccaaagtaacactgatgccaccggggctttactgacccagaccgatgccaaaggcaacattcagcggctggcctatgatgtggccgggcagctaaaagggagttggttaacactcaaaggtcaggcggaacaggtgattatcaaatcgctaacctactccgccgccgggcaaaaattacgtgaagagcacggtaacgggattgtcactgaatacagctacgaaccggaaacccaacggcttatcggcattaccactcgccgtccatcagacgccaaggtgttgcaagacctacgctatcaatatgacccagtaggcaatgtcattagtatccgtaatgatgcggaagccactcgcttttggcgcaatcagaaagtagccccggagaatagctatacctacgattccctgtatcagcttatcagcgccaccgggcgcgagatggccaatatcggtcagcaaagcaaccaacttccctctccggcgctaccttctgataacaatacctacaccaactatactcgcacttatacttatgaccgtggcggcaatttgacgaaaattcagcatagttcaccagccgcgcaaaataactacacgacggatataacggtttcaaatcgcagcaaccgcgcggtactcagcacattgaccgcagatccaactcaagtcgatgccttatttgatgcgggaggccatcaaaccagcttgttatccggccaagttctaacttggacaccgcgaggcgaattgaaacaagccaacaatagcgcaggaaatgagtggtatcgctacgatagcaacggcatacgccagctaaaagtgaatgaacaacaaactcagaatatcccgcaacaacaaagggtaacttatctaccggggctggaaatacgtacaacccagaacaacgccacaacaacagaagagttacacgttatcacactcggtaaagccggccgcgcgcaagtccgagtattgcattgggagagcggtaaaccagaagatattaataacaatcagcttcgttacagctacgataatcttattggctccagccaacttcaattagatagcgacggacaaattatcagtgaagaagaatattatccatttggtggtacagcgctgtgggcggcaaggaatcaaaccgaagccagctataaaaccattcgttattctggtaaagagcgggatgttaccgggctgtattattatggctaccgttattaccaaccgtgggcgggcagatggttaggtgcagacccggcaggaaccattgatggactgaatttatatcgcatggtgagaaataacccggtgacgcaatttgatgttcagggattatcaccggccaacagaacagaagaagcgataataaaacagggttcctttacgggaatggaagaagctgtttataaaaaaatggctaaacctcaaactttcaaacgccaaagagctatcgctgcccaaacagagcaagaagcccatgaatcattgaccaacaaccctagtgtagatattagcccaattaaaaactacaccacagatagctcacaaattaatgccgcgataagggaaaatcgtattacgccagcagtggaaagtttagacgccacattatcttccctacaagatagacaaatgagggtaacttatcgggtgatgacctatgtagataattccacgccatcgccttggcactcgccacaggaaggaaatagtattaatgttggtgatatcgtttcggataacgcttatttatcaacatcggcccatcgtggttttctgaattttgttcacaaaaaagaaaccagtgaaactcgatacgtcaagatggcatttttaacgaatgcgggtgtcaatgtcccagcagcatctatgtataataatgctggcgaggagcaagtatttaaaatggatttaaacgattcaagaaaaagccttgctgaaaaattaaaactaagagtcagtggaccacaatcgggacaagcggaaatattactacctagggaaacacagttcgaagttgtttcaatgaaacatcaaggcagagatacctatgtattattgcaagatattaaccaatccgcagccactcatagaaatgtacgtaacacttacaccggtaatttcaaatcatccagtgcaaattaa

SEQ ID NO: 39 - DNA, 3048 bp, Xenorhabdus nematophilus
atgaagaatttcgttcacagcaatacgccatccgtcaccgtactggacaaccgtggtcagacagtacgcgaaatagcctggtatcggcaccccgatacacctcaggtaaccgatgaacgcatcaccggttatcaatatgatgctcaaggatctctgactcagagtattgatccgcgattttatgaacgccagcagacagcgagtgacaagaacgccattacacccaatcttattctcttgtcatcactcagtaagaaggcattgcgtacgcaaagtgtggatgccggaacccgtgtcgccctgcatgatgttgccgggcgtcccgttttagctgtcagcgccaatggcgttagccgaacgtttcagtatgaaagtgataaccttccgggacgattgctaacgattaccgagcaggtaaaaggagagaacgcctgtatcacggagcgattgatctggtcaggaaatacgccggcagaaaaaggcaataatctggccggccagtgcgtggtccattatgatcccaccggaatgaatcaaaccaacagcatatcgttaaccagcatacccttgtccatcacacagcaattactgaaagatgacagcgaagccgattggcacggtatggatgaatctggctggaaaaacgcgctggcgccggaaagcttcacttctgtcagcacaacggatgctaccggcacggtattaacgagtacagatgctgccggaaacaagcaacgtatcgcctatgatgtggccggtctgcttcaaggcagttggttggcgctgaaggggaaacaagaacaagttatcgtgaaatccctgacctattcggctgccagccagaagctacgggaggaacatggtaacgggatagtgactacatatacctatgaacccgagacgcaacgagttattggcataaaaacagaacgtccttccggtcatgccgctggggagaaaattttacaaaacctgcgttatgaatatgatcctgtcggaaatgtgctgaaatcaactaatgatgctgaaattacccgcttttggcgcaaccagaaaattgtaccggaaaatacttacacctatgacagcctgtaccagctggtttccgtcactgggcgtgaaatggcgaatattggccgacaaaaaaaccagttacccatccccgctctgattgataacaatacttatacgaattactctcgcacttacgactatgatcgtgggggaaatctgaccagaattcgccataattcaccgatcaccggtaataactatacaacgaacatgaccgtttcagatcacagcaaccgggctgtactggaagagctggcgcaagatcccactcaggtggatatgttgttcacccccggcgggcatcagacccggcttgttcccggtcaggatcttttctggacaccccgtgacgaattgcaacaagtgatattggtcaatagggaaaatacgacgcctgatcaggaattctaccgttatgatgcagacagtcagcgtgtcattaagactcatattcagaagacaggtaacagtgagcaaatacagcgaacattatatttgccagagctggaatggcgcacgacatatagcggcaatacattaaaagagtttttgcaggtcatcactgtcggtgaatcgggtcaggcacaagtgcgggtgctgcattgggaaacaggcaaaccggcggatatcagcaatgatcagctgcgctacagttatggcaacctgattggcagtagcgggctggaattggacagtgacgggcagatcattagtcaggaagaatattacccctatgggggaaccgccgtgtgggcagcccgaagtcagtcagaagctgattacaaaaccgtgcgttattctggcaaagagcgggatgcaacagggttgtattactacggttatcgttattatcaatcgtggacagggcgatggttgagtgtagatcctgccggtgaggtcgatggtctcaatttgttccgaatgtgcaggaataaccccatcgttttttctgattctgatggtcgtttccccggtcagggtgtccttgcctggatagggaaaaaagcgtatcgaaaggcagtcaacatcacgacagaacacctgcttgaacaaggcgcttcctttgatacgttcttgaaattaaaccgaggattgcgaacgtttgttttgggtgtgggggtagcaagtctgggggtgaaggcggccacgattgcaggagcgtcgccttgggggattgtcggggctgccattggtggttttgtctccggggcggtgatggggtttttcgcgaacaacatctcagaaaaaattggggaagttttaagttatctgacgcgtaaacgttctgttcctgttcaggttggcgcttttgttgtcacatcgcttgtgacgtctgcactatttaacagctcttcgacaggtaccgccatttccgcagcaacagcggtcaccgttggaggattaatggctttagccggagagcataacacgggcatggctatcagtattgccacacccgccggacaaggtacgctggatacgctcaggcccggtaatgtcagcgcgccagagcggttaggggcactatcaggcgcaattattggcggcatattacttggccgccatcagggaagttctgagctgggtgaacgggcagcgattggtgctatgtatggtgctcgatggggaaggatcattggtaatctatgggatggcccttatcggtttatcggcaggttactgctcagaagaggcattagctctgccatttcccacgctgtcagttccaggagctggtttggccgaatgataggagaaagtgtcgggagaaatatttctgaagtattattaccttatagccgtacacccggtgaatgggttggtgcagccattggcgggacagccgcggccgctcatcatgccgttggaggggaagttgccaatgccgctagccgggttacctggagcggctttaagcgggcttttaataacttcttctttaacgcctctgcacgtcataatgaatccgaagca

SEQ ID NO: 40 - DNA, 2889 bp, Xenorhabdus bovienii
atgaatgtttttaatccaactttatatgccggtacaccgactgtcaccgtcatggacaatcgagggctgtcagtgcgggatattgcttatcaccgtacaacagcaggagagcaggctgacactcgcatcacccgccatcaatacagtccccataattttttaatcgagagcattgatccacgcctttttgatttgcaatctcagagcaccataaaacctaatttcacctactgtcctgccttgaagggtgatgtcctacggacagagagtgtggatgccggacaaactgtcattttgagtgacatcgaaggtcgtccgttactgaatatcagtgcgatgggtgtcgtcaaacactggcaatatgaagagagtacattgccggggcgcttgctcgctgtcagtgaacggaagaatgaggcttcaacaccccaaattattgaacggtttatttggtcgggaaatagcccatcagaaaaagatcacaatttggcgggaaaatatcttcgtcattatgataccgccggattaaaccagcttaatgctgtgtctctgaccagcgtggatctctcacaatcccgtcagttattgcaggatgatgtcacagcagattggagcggaagtgacgaatcccagtggaagacgcgactgagtaacgacatattcacaaccgaaatcaccgctgatgcggttggcaatttcttgactcagaatgatgccaaaagcaaccagcaacgattgtcctatgatgtggcagggcagttaaaggcaagctggctgacgataaaaggccagaatgagcaggtgatagttaactccctgacttactccgccgcagggcagaaactgcgtgaagagcagggtaacggcgttgtcactgaatactcctatgaagcacaaacctggcgtttgataggtgtaacggcttaccgtcagtcagataaaaaaagattgcaggatcttgtctataactatgatccggtcggtaatctcctgaatattcgcaataatgcagaggcaacccgtttctggcgtaatcagatagtagaaccagagaaccactatgcttatgactcgctttatcaactcatcagtgctagtggtcgagaaatcgccagtatcggtcagcagggcagccggctgcctgtaccgattattcctcttcctgccaatgacgatgtttatactcgctacacccgcacatatcactatgatcgcggtggaaatctctgccagatccggcattgcgctcctgctacagataataagtacaccacaaagatcaccgtatcgaatcgtagtaatcgtgcagtatgggataccttgaccacagatcccgccaaagtggataccctgtttgatcatggagggcatcaacttcaactccagtcaggccagactttatgttggaactatcggggtgaactacagcaaataacaaagatacagcgtgacgaaaaacccgcagataaagagcggtatcgctatggtgttggggctgcgcgggtcgtgaaaatcagcacacagcaggcggggggaagcagccatgtgcagcgtgttgtttatctgccggggttggaactacgcacaactcagcatgatgcgacattaatcgaagacttacaggtgattatcatgggtgaagcaggacgtgctcaggtacgcgtacttcattgggaaataccaccaccggataatcttaacaatgactcactgcgttacagctacgatagtttgatgggttccagtcagcttgaattggatggagcagggcagattattacgcaggaagaatactacccctatggaggtacagcaatatgggcggcaagaaaccagaccgaagccaattacaaaaccattcgctactccggcaaagagcgtgatgcgacggggctttattactacgggcaccgttattatcagccgtggctagggcgctggttgagcgcagatcccgccggaaccgtggacggactgaatctatatcgaatggtgaggaataacccgattacttaccgggatgcagatgggcttgcgccgataggcgataagatcagcgaagggatttatgagcctgagttgcgagttggtcttgaacgagatgacccaaatgtcagagattatgaccgggtttatcctgatacggccaagacagagatgatcgaagcaactgcgaccacaattgctcccagtcaaatgttatcggcgcatgcttttgcatctgtacctatattgacagatttgtttaatcctcaaacagcaaggctttctcaaaagacaacggatattgtattaaacacacaaggtggaggcgatttaatctttactggcatgaatattaaaggtaagggaaaagaatttaatgcattaaaaatcgttgatacttatggcggagaaatgcctgatagcaaaaccgctatttcagcatattggcttccgcaaggtgggtatactgatattccgatacatccgactggaatacaaaagtatttgtttacgcctgcgtttagtggttgcactctggcagtagataagcttaacgaaaatacattacgggcgtatcacgtcgaaggaagtaaggaagatgctcaatataataatttagcagttgcagcgcacggagagggtttggtcatggctatggaatttcctgactatggatttcatacagacaaaacagggcaaagactaaggaacacacagggatttgcgtttatgtcctacaatcaatcccagaaaaaatgggaaattcattatcaaaggcaagcattgacatcaaacaccggtatcatgaatgttagtgctaaaaacaagattcgattgaatgcccccagtcatgtaaaaaatagctcaatcaaaggaactgaaataatgacgacacatttttaa

SEQ ID NO: 41 - DNA, 2862 bp, Paenibacillus strain DAS1529
atgaaaatgataccgtggactcaccattatttgcttcaccgcctgcgcggtgagatggaggttaaacctatgaacacaacgtccatatataggggcacgcctacgatttcagttgtggataaccggaacttggagattcgcattcttcagtataaccgtatcgcggctgaagatccggcagatgagtgtatcctgcggaacacgtatacgccgttaagctatcttggcagcagcatggatccccgtttgttctcgcaatatcaggatgatcgcggaacaccgccgaatatacgaaccatggcttccctgagaggcgaagcgctgtgttcggaaagtgtggatgccggccgcaaggcggagctttttgatatcgaggggcggcccgtctggcttatcgatgccaacggcacagagacgactctcgaatatgatgtcttaggcaggccaacagccgtattcgagcaacaggaaggtacggactccccccagtgcagggagcggtttatttatggtgagaaggaggcggatgcccaggccaacaatttgcgcggacaactggttcgccactacgataccgcgggccggatacagaccgacagcatctccttggctggactgccgttgcgccaaagccgtcaactgctgaaaaattgggatgaacctggcgactggagtatggatgaggaaagcgcctgggcctcgttgctggctgccgaagcttatgatacgagctggcggtatgacgcgcaggacagggtgctcgcccaaaccgacgccaaagggaatctccagcaactgacttacaatgacgccggccagccgcaggcggtcagcctcaagctgcaaggccaagcggagcaacggatttggaaccggatcgagtacaacgcggcgggtcaagtggatctcgccgaagccgggaatggaatcgtaacggaatatacttacgaggaaagcacgcagcggttaatccgaaaaaaagattcccgcggactgtcctccggggaaagagaagtgctgcaggattatcgttatgaatatgatccggtaggcaatatcctttctatttacaatgaagcggagccggttcgttatttccgcaatcaggccgttgctccgaaaaggcaatatgcctacgatgccttgtatcagcttgtatctagttcggggcgggaatccgacgcgcttcggcagcagacgtcgcttcctcccttgatcacgcctatccctctggacgatagccaatacgtcaattacgctgaaaaatacagctatgatcaggcgggcaatttaatcaagcttagccataacggggcaagtcaatatacaacgaatgtgtatgtggacaaaagctcaaaccgggggatttggcggcaaggggaagacatcccggatatcgcggcttcctttgacagagcaggcaatcaacaagctttattcccggggagaccgttggaatgggatacacgcaatcaattaagccgtgtccatatggtcgtgcgcgaaggcggagacaacgactgggaaggctatctctatgacagctcgggaatgcgtatcgtaaaacgatctacccgcaaaacacagacaacgacgcaaacggatacgaccctctatttgccgggcctggagctgcgaatccgccagaccggggaccgggtcacggaagcattgcaggtcattaccgtggatgagggagcgggacaagtgagggtgctgcactgggaggatggaaccgagccgggcggcatcgccaatgatcagtaccggtacagcctgaacgatcatcttacctcctctttattggaagttgacgggcaaggtcagatcattagtaaggaagaattttatccctatggcggcacagccctgtggacagcccggtcagaggtagaggcaagctacaagaccatccgctattcaggcaaagagcgggatgccacaggcctgtattattacggacaccgctactatatgccatggttgggtcgctggctgaatccggacccggccggaatggtagatggactaaacctgtaccgtatggtcaggaacaatcctataggactgatggatccgaatgggaatgcgccaatcaacgtggcggattatagcttcgtgcatggtgatttagtttatggtcttagtaaggaaagaggaagatatctaaagctatttaatccaaactttaatatggaaaaatcagactctcctgctatggttatagatcaatataataataatgttgcattgagtataactaaccaatataaagtagaagaattgatgaaatttcaaaaagacccacaaaaagccgcacggaaaataaaggttccagaagggaatcgtttatcgaggaacgaaaattatcctttgtggcacgattatattaacattggagaagctaaagctgcatttaaggcctctcatattttccaagaagtgaaggggaattatgggaaagattattatcataaattattattagacagaatgatagaatcgccgttgctgtggaaacgaggcagcaaactcgggctagaaatcgccgctaccaatcagagaacaaaaatacactttgttcttgacaatttaaatatcgagcaggtggttacgaaagagggtagcggcggtcagtcaatcacagcttcggagctccgttatatttatcgaaatcgcgaaagattgaacgggcgtgtcattttctatagaaataatgaaaggctagatcaggctccatggcaagaaaatccggacttatggagcaaatatcaaccgggtcttagacaaagcagcagttcaagagtcaaagaacgagggattgggaactttttccgccggttttcaatgaagagaaagtaa

SEQ ID NO: 42 - DNA, 2793 bp, Paenibacillus strain DAS1529
atgaacacaacgtccatatataggggcacgcctacgatttcagttgtggataaccggaacttggagattcgcattcttcagtataaccgtatcgcggctgaagatccggcagatgagtgtatcctgcggaacacgtatacgccgttaagctatcttggcagcagcatggatccccgtttgttctcgcaatatcaggatgatcgcggaacaccgccgaatatacgaaccatggcttccctgagaggcgaagcgctgtgttcggaaagtgtggatgccggccgcaaggcggagctttttgatatcgaggggcggcccgtctggcttatcgatgccaacggcacagagacgactctcgaatatgatgtcttaggcaggccaacagccgtattcgagcaacaggaaggtacggactccccccagtgcagggagcggtttatttatggtgagaaggaggcggatgcccaggccaacaatttgcgcggacaactggttcgccactacgataccgcgggccggatacagaccgacagcatctccttggctggactgccgttgcgccaaagccgtcaactgctgaaaaattgggatgaacctggcgactggagtatggatgaggaaagcgcctgggcctcgttgctggctgccgaagcttatgatacgagctggcggtatgacgcgcaggacagggtgctcgcccaaaccgacgccaaagggaatctccagcaactgacttacaatgacgccggccagccgcaggcggtcagcctcaagctgcaaggccaagcggagcaacggatttggaaccggatcgagtacaacgcggcgggtcaagtggatctcgccgaagccgggaatggaatcgtaacggaatatacttacgaggaaagcacgcagcggttaatccgaaaaaaagattcccgcggactgtcctccggggaaagagaagtgctgcaggattatcgttatgaatatgatccggtaggcaatatcctttctatttacaatgaagcggagccggttcgttatttccgcaatcaggccgttgctccgaaaaggcaatatgcctacgatgccttgtatcagcttgtatctagttcggggcgggaatccgacgcgcttcggcagcagacgtcgcttcctcccttgatcacgcctatccctctggacgatagccaatacgtcaattacgctgaaaaatacagctatgatcaggcgggcaatttaatcaagcttagccataacggggcaagtcaatatacaacgaatgtgtatgtggacaaaagctcaaaccgggggatttggcggcaaggggaagacatcccggatatcgcggcttcctttgacagagcaggcaatcaacaagctttattcccggggagaccgttggaatgggatacacgcaatcaattaagccgtgtccatatggtcgtgcgcgaaggcggagacaacgactgggaaggctatctctatgacagctcgggaatgcgtatcgtaaaacgatctacccgcaaaacacagacaacgacgcaaacggatacgaccctctatttgccgggcctggagctgcgaatccgccagaccggggaccgggtcacggaagcattgcaggtcattaccgtggatgagggagcgggacaagtgagggtgctgcactgggaggatggaaccgagccgggcggcatcgccaatgatcagtaccggtacagcctgaacgatcatcttacctcctctttattggaagttgacgggcaaggtcagatcattagtaaggaagaattttatccctatggcggcacagccctgtggacagcccggtcagaggtagaggcaagctacaagaccatccgctattcaggcaaagagcgggatgccacaggcctgtattattacggacaccgctactatatgccatggttgggtcgctggctgaatccggacccggccggaatggtagatggactaaacctgtaccgtatggtcaggaacaatcctataggactgatggatccgaatgggaatgcgccaatcaacgtggcggattatagcttcgtgcatggtgatttagtttatggtcttagtaaggaaagaggaagatatctaaagctatttaatccaaactttaatatggaaaaatcagactctcctgctatggttatagatcaatataataataatgttgcattgagtataactaaccaatataaagtagaagaattgatgaaatttcaaaaagacccacaaaaagccgcacggaaaataaaggttccagaagggaatcgtttatcgaggaacgaaaattatcctttgtggcacgattatattaacattggagaagctaaagctgcatttaaggcctctcatattttccaagaagtgaaggggaattatgggaaagattattatcataaattattattagacagaatgatagaatcgccgttgctgtggaaacgaggcagcaaactcgggctagaaatcgccgctaccaatcagagaacaaaaatacactttgttcttgacaatttaaatatcgagcaggtggttacgaaagagggtagcggcggtcagtcaatcacagcttcggagctccgttatatttatcgaaatcgcgaaagattgaacgggcgtgtcattttctatagaaataatgaaaggctagatcaggctccatggcaagaaaatccggacttatggagcaaatatcaaccgggtcttagacaaagcagcagttcaagagtcaaagaacgagggattgggaactttttccgccggttttcaatgaagagaaagtag

SEQ ID NO: 43 - DNA, 4428 bp, Artificial Sequence
  Nucleic acid sequence optimized for expression in plants that encodes the Class B TC protein TcdB2
atggctcaaaattcccaggacttctccataactgaactcagcttgcccaagggtggaggtgccatcactgggatgggtgaggccctcacaccaactggccctgatgggatggctgcactctccttgcccttgccaatctccgctggaagaggctatgcacctgccttcacactcaactacaactctggtgctgggaactcaccctttggacttggctgggactgcaatgtgatgaccataaggaggcgcacccactttggtgttccacactatgatgagactgacaccttccttggaccagaaggtgaggtgcttgttgtcgctgaccagccacgtgatgagagcaccttgcaagggatcaaccttggtgccaccttcacagtgactggctaccgcagcagacttgagtcacacttcagcagacttgagtattggcaacccaagaccactgggaagactgacttctggctcatctactcccctgatggccaagttcatctccttgggaagtcaccacaggcacgcatctccaacccctcacaaaccacacagactgcacagtggctccttgaagcctcagtcagctcccgtggtgaacagatctactaccagtacagagctgaagatgacactggctgtgaggctgatgagataacccatcacctccaagccacagcacaacgctacctccacattgtctactatgggaacaggactgcctcagagacactccctggacttgatggctctgcaccctcccaagctgactggttgttctaccttgtctttgactatggtgaacgctccaacaatttgaagaccccacctgccttcagcaccactggctcctggctctgccgtcaggaccgcttcagcagatatgagtatggctttgagataaggacaaggcgcctttgcagacaagtcttgatgtaccatcacctccaagcacttgactccaagatcactgaacacaatggacccacccttgtgagccgtctcatcttgaactatgatgagtcagccattgcctccacacttgtctttgtcaggcgtgttggccatgagcaagatgggaatgttgtcacccttccacccttggaacttgcctaccaggacttcagccccaggcaccatgcacactggcagccaatggatgtccttgccaacttcaatgccattcaacgctggcagcttgttgacttgaagggtgaaggcctcccaggactcttgtaccaagacaagggtgcctggtggtaccgcagcgcacagaggcttggtgagattggctctgatgctgtgacctgggagaagatgcagcccttgtcagtgattcccagcctccagagcaatgcctcccttgttgacatcaatggtgatgggcagcttgactgggtgataacaggccctggcttgagaggctaccacagccagaggcctgatggctcctggacacgcttcacccccttgaacgcactcccagttgagtacacccatccacgtgcccaacttgctgacttgatgggtgctggcctctctgaccttgtcttgattggacccaagtctgttagactctatgccaacacacgtgatggctttgccaaagggaaggatgttgtccagtctggtgacataaccttgcctgtgcctggtgctgatccacgcaaacttgttgccttctcagatgttcttggctctgggcaagcacatcttgttgaagtctcagccactaaggttacttgttggccaaatttgggaagaggcagattcggacagcctattacactccctggcttcagccaacctgccactgagttcaaccctgcccaagtctacttggctgaccttgatggctctggacccactgatctcatctatgttcacaccaacaggcttgacatcttcttgaacaagtctgggaatggcttcgctgaacctgtgacattgcgctttcctgaaggcctccgctttgaccacacctgccagctccaaatggctgatgtgcaaggccttggtgttgcctccttgattctctctgttccacacatgtcaccacatcactggcgttgtgatctcaccaacatgaagccctggctcttgaatgagatgaacaacaacatgggtgttcatcacacattgcgctacagaagctcaagccagttctggcttgatgagaaggctgccgcactcaccactggccagaccccagtctgctacctccccttccccattcacaccttgtggcagactgagactgaagatgagatttctgggaacaaacttgtgaccacattgcgctatgcacgtggtgcctgggatggacgtgagcgtgagttccgtggctttggctacgttgagcagactgacagccatcagcttgcacaagggaacgcaccagagcgcaccccacctgcactcaccaagaactggtacgccacaggcctcccagtgattgacaatgcactcagcactgagtactggcgcgatgaccaagcctttgctggcttctcaccccgcttcaccacatggcaagacaacaaggatgttcccttgacccctgaagatgacaactcccgctactggttcaaccgtgccctcaagggccaactcttgaggtctgaactctatggacttgatgacagcaccaacaaacatgtcccctacacagtgactgagttccgctcccaagtgaggcgcctccagcacactgacagccgttaccctgtcttgtggtccagcgtcgttgagtctagaaactaccactacgagaggattgcctctgatccacaatgcagccagaacattacactctccagcgaccgctttggacagccactcaaacaactctcagtgcagtacccaaggcgccagcaacctgccatcaacttgtaccctgacaccctccctgacaaactccttgccaactcatatgatgaccagcaaaggcaactcaggttgacctaccaacagtccagctggcatcacttgaccaacaacactgttcgtgtgcttggactccctgacagcacacgctctgacatcttcacctatggtgctgagaatgtgcctgctggtggcctcaaccttgaactcttgtctgacaaaaattccttgattgctgatgacaaaccacgtgagtaccttggacagcagaagacagcctacaccgatggccagaacaccacaccactccaaacccccaccaggcaagccttgattgccttcactgagaccacagtcttcaaccagtcaacactctctgccttcaatgggagcataccctctgacaagttgtcaaccacacttgaacaggctggctaccagcaaacaaactacctctttcccaggactggtgaagacaaggtctgggttgcacatcacggctacactgactatgggacagctgcacaattctggaggcctcagaaacaatccaacacccaactcactgggaagatcaccttgatttgggatgctaactactgtgtcgttgtccagactcgtgatgctgctggactcaccacatctgccaagtatgactggcgctttctcacccctgtgcaactcactgacatcaacgacaaccagcacttgataacccttgatgcacttggccgtccaatcacattgcgcttctgggggactgagaatgggaagatgacaggctacagctcccctgagaaggccagcttctccccaccctctgatgtcaatgctgccattgaactcaaaaaaccactccctgttgcacagtgccaagtctatgccccagagagctggatgcctgtcttgagccaaaagaccttcaaccgtcttgctgaacaggactggcagaaactctacaatgcacgcataatcactgaagatggacgcatctgcacacttgcctacagaaggtgggtgcaatcacagaaggccattccacaactcataagcctcttgaacaatggacccaggctcccaccacacagcttgacactcaccactgacagatatgaccatgatccagagcagcaaatcaggcaacaggttgtcttctcagatggctttggacgtttgctccaagctgccgctcgccatgaagctgggatggcacgtcagaggaacgaagatggctccttgatcatcaatgttcagcacactgagaacaggtgggctgtgactggacgcactgagtatgacaacaaggggcagccaatcaggacctaccagccctactttctcaatgactggagatatgtctccaatgactcagcacgtcaggagaaggaagcctatgctgacacccatgtctatgatccaattggacgtgagatcaaggtgataactgccaagggctggttcagacgcacactcttcaccccctggttcactgtgaacgaagatgagaatgacacagctgctgaagtgaagaaggtcaagatgtga

SEQ ID NO: 44 - DNA, 2886 bp, Artificial Sequence
  Nucleic acid sequence optimized for expression in plants that encodes the Class C TC protein TccC3
atggccaagaacattgacccaaaattgtaccaaaagactcccactgtgtctgtttacgacaatcgtggcttgatcataagaaacattgacttccataggacaactgccaatggagaccctgacaccagaatcaccaggcatcagtatgacattcatgggcacctcaaccagagcattgacccaagactctacgaagccaagcagacaaacaacaccatcaagcccaacttcctttggcagtatgacttgactggcaaccctctctgcactgaatccatagatgctggccgcactgtcacattgaatgacattgagggccgccctcttctcactgtcactgccactggtgtcatccaaaccaggcagtatgagaccagctcactccctggccgccttctctctgtggcagaacaaactcccgaggaaaagacaagccgcataactgagagactcatctgggctggcaacactgaagcagagaaagaccacaacttggctgggcagtgtgtgaggcactatgacactgctggagtcacaaggttggagtcgttgtccctcactggcactgtcctttcccagtccagccaactcctcattgacacccaagaagccaactggactggtgacaatgagactgtttggcagaacatgttggctgatgacatctacaccacactctcaaccttcgatgccactggagcactcctcacacagactgatgccaaaggcaacatccaaagattggcctatgatgtggctggccaactcaatgggtcatggctcaccctcaagggacagactgagcaagtgatcatcaagtccctcacatactctgctgctgggcagaagttgagagaggaacatggcaatgatgtcataactgagtacagctatgagcctgagacccagagactcattggcatcaagaccaggaggccctctgacaccaaagttcttcaagatcttcgctatgagtatgaccctgtgggcaatgtgatctcaatcaggaatgatgcagaagccacaaggttctggcacaatcagaaggtcatgcctgagaacacctacacctatgacagcctctaccaactcatctctgccactggccgtgagatggccaacattgggcaacaatcacaccagtttcccagcccagcactcccatctgacaacaacacatacaccaactacaccagaacatacacctatgatcgtggtggcaacctcacaaaaatccaacacagcagcccagccacacagaacaactacaccaccaacatcactgtgagcaacaggagcaacagagcagtcttgtcgacactcactgaggacccagcacaggtggatgcactctttgatgctggtgggcaccagaacaccctcatctctggccagaatctcaactggaacacccgtggtgagttgcaacaggtgacattggtcaagagggacaagggagccaatgatgacagagaatggtaccgctactctggtgatggccgccgcatgttgaagatcaatgagcaacaggcctccaacaatgcacagacccagagggtcacatacttgcccaaccttgagttgaggctcacccagaacagcactgccaccactgaggaccttcaagtcatcactgtgggagaagccggccgtgctcaggtcagggttcttcactgggagtctggcaaacccgaggacatagacaacaaccagctcaggtacagctacgacaatctcattggctcatcccagttggagttggactctgaaggccaaatcatatctgaggaagagtactacccttatggaggcactgcactttgggctgccaggaaccagactgaggcaagctacaagacaatcaggtactctggcaaggagagggatgccactggactctactactatggttaccgctactaccaaccttggattggccgctggctttcctctgatcccgctggcaccattgatggtctcaacctctaccgcatggtcaggaacaaccctgtcacattgcttgaccctgatggactcatgcccaccattgcagagaggattgctgccttgaagaagaacaaggtcactgactctgctcccagcccagccaatgccaccaatgtggccatcaacataagaccacctgtggctcccaagccctcacttcccaaggcttccaccagctcacaacccacaactcaccctattggtgctgccaacatcaagcccaccacctctgggtccagcattgtggctcctctcagccctgtgggcaacaagtcaacctctgagatcagccttcccgagtctgctcagtcctcctcatcaagcaccaccagcaccaacctccagaagaagtccttcaccctctaccgtgctgacaacagatcctttgaagagatgcagtccaagttcccagagggcttcaaggcttggactcctcttgacacaaaaatggccagacaattcgcttccatcttcatcgggcagaaggacaccagcaaccttcccaaggagactgtcaagaacatctccacctggggtgccaagcccaagctcaaggacctttccaactacatcaagtacaccaaggacaagtccactgtttgggtttccactgccatcaatactgaagctggtgggcagtcctctggtgctccactccacaaaattgacatggacctctatgagttcgccattgatgggcagaagctcaacccactcccagagggccgcacaaagaacatggttccctccctcctccttgacactccacagattgagacctcctccatcattgctctcaatcacgggccagtgaacgatgctgagatctcattcctcaccaccataccactcaaaaatgtcaagccacataagaggtga

SEQ ID NO: 45 - DNA, 7313 bp, Artificial Sequence
  Nucleic acid sequence encoding TcdB2/TccC3 fusion protein pDAB8563
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatccggtctcataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 46 - protein, 2416 aa, Artificial Sequence
  TcdB2/TccC3 fusion protein pDAB8563
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 47 - DNA, 7367 bp, Artificial Sequence
  Nucleic acid sequence encoding TcdB2/TccC3 fusion protein pDAB8564
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgatgaaaaacatcgatcccaaactttatcaaaaaacccctactgtcagcgtttacgataaccgtggtctcataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 48 - protein, 2434 aa, Artificial Sequence
  TcdB2/TccC3 fusion protein pDAB8564
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 49 - DNA, 7382 bp, Artificial Sequence
  Nucleic acid sequence encoding TcdB2/TccC3 fusion protein pDAB8940
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatctaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 50 - protein, 2439 aa, Artificial Sequence
  TcdB2/TccC3 fusion protein pDAB8940
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 51 - DNA, 7409 bp, Artificial Sequence; identical to SEQ ID NO: 1
  Nucleic acid sequence encoding TcdB2/TccC3 fusion protein pDAB8920

SEQ ID NO: 52 - protein, 2448 aa, Artificial Sequence; identical to SEQ ID NO: 2
  TcdB2/TccC3 fusion protein pDAB8920

SEQ ID NO: 53 - DNA, 7481 bp, Artificial Sequence
  Nucleic acid sequence encoding TcdB2/TccC3 fusion protein pDAB8921
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccacgtctggaccgcgcagcagatatcactacccaaaatgctcacgacagcgcaattgtcgctctgcgtcagaatattcctactccggcacctctgtccctgcgcagcaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 54 - protein, 2472 aa, Artificial Sequence
  TcdB2/TccC3 fusion protein pDAB8921
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPRLDRAADITTQNAHDSAIVALRQNIPTPAPLSLRSRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 55 - DNA, 7646 bp, Artificial Sequence
  Nucleic acid sequence encoding TcdB2/TccC3 fusion protein pDAB8923
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatccgaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccacgtctggaccgcgcagcagatatcactacccaaaatgctcacgacagcgcaattgtcgctctgcgtcagaatattcctactccggcacctctgtccctgcgcagcaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 56 - protein, 2527 aa, Artificial Sequence
  TcdB2/TccC3 fusion protein pDAB8923
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSEAYADTHVYDPIGREIKVITAKGWFRRTLFTPWFTVNEDENDTAAEVKKVKMPRLDRAADITTQNAHDSAIVALRQNIPTPAPLSLRSRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 57 - DNA, 7454 bp, Artificial Sequence
  Nucleic acid sequence encoding TcdB2/TccC3 fusion protein pDAB8951
aaacaagaaggagatataccatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaagaatgtaaaacctcataagagaccacgtctggaccgcgcagcagatatcactacccaaaatgctcacgacagcgcaattgtcgctctgcgtcagaatattcctactccggcacctctgtccctgcgcagcaggcctatgcaaaattcacaagattttagtattacggagctctcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgtaattaatctgactcgag

SEQ ID NO: 58 - protein, 2472 aa, Artificial Sequence
  TcdB2/TccC3 fusion protein pDAB8951
MKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKRPRLDRAADITTQNAHDSAIVALRQNIPTPAPLSLRSRPMQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKM

SEQ ID NO: 59 - DNA, 15036 bp, Artificial Sequence
  Nucleic acid sequence encoding TcdB2/TccC3 fusion protein pDAB8811
tctagacgtgcgtcgacaagaaggagatataccatgtatagcacggctgtattactcaataaaatcagtcccactcgcgacggtcagacgatgactcttgcggatctgcaatatttatccttcagtgaactgagaaaaatctttgatgaccagctcagttggggagaggctcgccatctctatcatgaaactatagagcagaaaaaaaataatcgcttgctggaagcgcgtatttttacccgtgccaacccacaattatccggtgctatccgactcggtattgaacgagacagcgtttcacgcagttatgatgaaatgtttggtgcccgttcttcttcctttgtgaaaccgggttcagtggcttccatgttttcaccggctggctatctcaccgaattgtatcgtgaagcgaaggacttacatttttcaagctctgcttatcatcttgataatcgccgtccggatctggctgatctgactctgagccagagtaatatggatacagaaatttccaccctgacactgtctaacgaactgttgctggagcatattacccgcaagaccggaggtgattcggacgcattgatggagagcctgtcaacttaccgtcaggccattgataccccttaccatcagccttacgagactatccgtcaggtcattatgacccatgacagtacactgtcagcgctgtcccgtaatcctgaggtgatggggcaggcggaaggggcttcattactggcgattctggccaatatttctccggagctttataacattttgaccgaagagattacggaaaagaacgctgatgctttatttgcgcaaaacttcagtgaaaatatcacgcccgaaaatttcgcgtcacaatcatggatagccaagtattatggtcttgaactttctgaggtgcaaaaatacctcgggatgttgcagaatggctattctgacagcacctctgcttatgtggataatatctcaacgggtttagtggtcaataatgaaagtaaactcgaagcttacaaaataacacgtgtaaaaacagatgattatgataaaaatataaattactttgatttgatgtatgaaggaaataatcagttctttatacgtgctaattttaaggtatcaagagaatttggggctactcttagaaaaaacgcagggccaagtggcattgtcggcagcctttccggtcctctaatagccaatacgaattttaaaagtaattatctaagtaacatatctgattctgaatacaaaaacggtgtaaagatatacgcctatcgctatacgtcttccaccagcgccacaaatcagggcggcggaatattcacttttgagtcttatcccctgactatatttgcgctcaaactgaataaagccattcgcttgtgcctgactagcgggctttcaccgaatgaactgcaaactatcgtacgcagtgacaatgcacaaggcatcatcaacgactccgttctgaccaaagttttctatactctgttctacagtcaccgttatgcactgagctttgatgatgcacaggtactgaacggatcggtcattaatcaatatgccgacgatgacagtgtcagtcattttaaccgtctctttaatacaccgccgctgaaagggaaaatctttgaagccgacggcaacacggtcagcattgatccggatgaagagcaatctacctttgcccgttcagccctgatgcgtggtctgggggtcaacagtggtgaactgtatcagttaggcaaactggcgggtgtgctggacgcccaaaataccatcacactttctgtcttcgttatctcttcactgtatcgcctcacgttactggcccgtgtccatcagctgacggtcaatgaactgtgtatgctttatggtctttcgccgttcaatggcaaaacaacggcttctttgtcttccggggagttgccacggctggttatctggctgtatcaggtgacgcagtggctgactgaggcggaaatcaccactgaagcgatctggttattatgtacgccagagtttagcgggaatatttcaccggaaatcagtaatctgctcaataacctccgaccgagtattagtgaagatatggcacagagtcacaatcgggagctgcaggctgaaattctcgcgccgtttattgctgcaacgctgcatctggcgtcaccggatatggcacggtatatcctgttgtggaccgataacctgcggccgggtggcttagatattgccgggtttatgacactggtattgaaagagtcgttaaatgccaatgaaaccacccaattggtacaattctgccatgtgatggcacagttatcgctttccgtacagacactgcgcctcagtgaagcggagctatccgtgctggtcatctccggattcgccgtgctgggggcaaaaaatcaacctgccggacagcacaatattgatacgctattctcactctaccgattccaccagtggattaatgggctgggcaatcccggctctgacacgctggatatgctgcgccagcagacactcacggccgacagactggcctccgtgatggggctggacatcagtatggtaacgcaggccatggtttccgccggcgtgaaccagcttcagtgttggcaggatatcaacaccgtgttgcagtggatagatgtggcatcagcactgcacacgatgccgtcggttatccgtacgctggtgaatatccgttacgtgactgcattaaacaaagccgagtcgaatctgccttcctgggatgagtggcagacactggcagaaaatatggaagccggactcagtacacaacaggctcagacgctggcggattataccgcggagcgcttgagtagcgtgctgtgcaattggtttctggcgaatatccagccagaaggggtgtccctgcacagccgggatgacctgtacagctatttcctgattgataatcaggtctcttctgccataaaaaccacccgactggcagaggccattgccggtattcagctctacatcaaccgggcgctgaatcggatagagcctaatgcccgtgccgatgtgtcaacccgccagttttttaccgactggacggtgaataaccgttacagcacctggggcggggtgtcgcggctggtttattatccggaaaattacattgacccaacccagcgtatcgggcagacccggatgatggatgaactgctggaaaatatcagccagagtaaacttagccgggacacagtggaggatgcctttaaaacttacctgacccgctttgaaaccgtggcggatctgaaagttgtcagcgcctatcacgacaacgtcaacagcaacaccggactgacctggtttgtcggccaaacgcgggagaacctgccggaatactactggtgtaacgtggatatatcacggatgcaggcgggtgaactggccgccaatgcctggaaagagtggacgaagattgatacagcggtcaacccctacaaggatgcaatacgtccggtcatactcagggaacgtttgcaccttatctgggtagaaaaagaggaagtggcgaaaaatggtactgatccggtggaaacctgtgaccgttttactctgaaactggcgtttctgcgtcatgatggcagttggagtgccccctggtcttacgatatcacaacgcaggtggaggcggtcactgacaaaaaacctgacactgaacggctggcgctggccgcatcaggctttcagggcgaggacactctgctggtgtttgtctacaaaaccgggaagagttactcggattttggcggcagcaataaaaatgtggcaggcatgaccatttacggcgatggctccttcaaaaagatggagaacacagcactcagccgttacagccaactgaaaaatacctttgatatcattcatactcaaggcaacgacttggtaagaaaggccagctatcgtttcgcgcaggattttgaagtgcctgcctcgttgaatatgggttctgccatcggtgatgatagtctgacggtgatggagaacgggaatattccgcagataaccagtaaatactccagcgataaccttgctattacgctacataacgccgctttcactgtcagatatgatggcagtggcaatgtcatcagaaacaaacaaatcagcgccatgaaactgacgggggtggatggaaagtcccagtacggcaatgcatttatcatcgcaaataccgttaaacattatggcggttactctgatctgggggggccgatcaccgtttataataaaacgaaaaactatattgcatcagttcaaggccacttgatgaacgcagattacactaggcgtttgattctaacaccagttgaaaataattattatgccagattgttcgagtttccattttctccaaacacaattttaaacaccgttttcacggttggtagcaataaaaccagtgattttaaaaagtgcagttatgctgttgatggtaataattctcagggcttccagatatttagttcctatcaatcatccggctggctggatattgatacaggcattaacaataccgatatcaaaattacggtgatggctggcagtaaaacccacacctttacggccagtgaccatattgcttccttgccggcaaacagttttgatgctatgccgtacacctttaagccactggaaatcgatgcttcatcgttggcctttaccaataatattgctcctctggatatcgtttttgagaccaaagccaaagacgggcgagtgctgggtaagatcaagcaaacattatcggtgaaacgggtaaattataatccggaagatattctgtttctgcgtgaaactcattcgggtgcccaatatatgcagctcggggtgtatcgtattcgtcttaataccctgctggcttctcaactggtatccagagcaaacacgggcattgatactatcctgacaatggaaacccagcggttaccggaacctccgttgggagaaggcttctttgccaactttgttctgcctaaatatgaccctgctgaacatggcgatgagcggtggtttaaaatccatattgggaatgttggcggtaacacgggaaggcagccttattacagcggaatgttatccgatacgtcggaaaccagtatgacactgtttgtcccttatgccgaagggtattacatgcatgaaggtgtcagattgggggttggataccagaaaattacctatgacaacacttgggaatctgctttcttttattttgatgagacaaaacagcaatttgtattaattaacgatgctgatcatgattcaggaatgacgcaacaggggatcgtgaaaaatatcaagaaatacaaaggatttttgaatgtttctatcgcaacgggctattccgccccgatggatttcaatagtgccagcgccctctattactgggaattgttctattacaccccgatgatgtgcttccagcgtttgctacaggaaaaacaattcgacgaagccacacaatggataaactacgtctacaatcccgccggctatatcgttaacggagaaatcgccccctggatctggaactgccggccgctggaagagaccacctcctggaatgccaatccgctggatgccatcgatccggatgccgtcgcccaaaatgacccaatgcactacaagattgccacctttatgcgcctgttggatcaacttattctgcgcggcgatatggcctatcgagaactgacccgcgatgcgttgaatgaagccaaaatgtggtatgtgcgtactttagaattgctcggtgatgagccggaggattacggtagccaacagtgggcagcaccgtccctttccggggcggcgagtcaaaccgtgcaggcggcttatcagcaggatcttacgatgctgggccgtggtggggtttccaagaatctccgtaccgctaactcgttggtgggtttgttcctgccggaatataacccggcgctcaccgattactggcaaaccctgcgtttgcgcctgtttaacctgcgccataatctttccattgacggacagccgttatcgctggcgatttacgccgagcctaccgatccgaaagcgctgctcaccagtatggtacaggcctctcagggcggtagtgcagtgctgcccggcacattgtcgttataccgcttcccggtgatgctggagcggacccgcaatctggtagcgcaattaacccagttcggcacctctctgctcagtatggcagagcatgatgatgccgatgaactcaccacgctgctactacagcagggtatggaactggcgacacagagcatccgtattcagcaacgaactgtcgatgaagtggatgctgatattgctgtattggcagagagccgccgcagtgcacaaaatcgtctggaaaaataccagcagctgtatgacgaggatatcaaccacggagaacagcgggcaatgtcactgcttgatgcagcggcaggtcagtctctggccgggcaggtgctttcaatagcggaaggggtggccgatttagtgccaaacgtgttcggtttagcttgtggcggcagtcgttggggggcagcactgcgtgcttccgcctccgtgatgtcgctttctgccacagcttcccaatattccgcagacaaaatcagccgttcggaagcctaccgccgccgccgtcaggagtgggaaattcagcgtgataatgctgacggtgaagtcaaacaaatggatgcccagttggaaagcctgaaaatccgccgcgaagcagcacagatgcaggtggaatatcaggagacccagcaggcccatactcaggctcagttagagctgttacagcgtaaattcacaaacaaagcgctttacagttggatgcgcggcaagctgagtgctatctattaccagttctttgacctgacccagtccttctgcctgatggcacaggaagcgctgcgccgcgagctgaccgacaacggtgttacctttatccggggtggggcctggaacggtacgactgcgggtttgatggcgggtgaaacgttgctgctgaatctggcagaaatggaaaaagtctggctggagcgtgatgagcgggcactggaagtgacccgtaccgtctcgttggcacagttctatcaggccttatcatcagacaactttaatctgaccgaaaaactcacgcaattcctgcgtgaagggaaaggcaacgtaggagcttccggcaatgaattaaaactcagtaaccgtcagatagaagcctcagtgcgattgtctgatttgaaaattttcagcgactaccccgaaagccttggcaatacccgtcagttgaaacaggtgagtgtcaccttgccggcgctggttgggccgtatgaagatattcgggcggtgctgaattacgggggcagcatcgtcatgccacgcggttgcagtgctattgctctctcccacggcgtgaatgacagtggtcaatttatgctggatttcaacgattcccgttatctgccgtttgaaggtatttccgtgaatgacagcggcagcctgacgttgagtttcccggatgcgactgatcggcagaaagcgctgctggagagcctgagcgatatcattctgcatatccgctataccattcgttctcctagggatcgtacccgtccaactagtatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatccgacaacaagggtcagactatccgcactaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagacactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagataattaatctgactcgag

SEQ ID NO: 60 - protein, 4995 aa, Artificial Sequence
  TcdB2/TccC3 fusion protein pDAB8811
MYSTAVLLNKISPTRDGQTMTLADLQYLSFSELRKIFDDQLSWGEARHLYHETIEQKKNNRLLEARIFTRANPQLSGAIRLGIERDSVSRSYDEMFGARSSSFVKPGSVASMFSPAGYLTELYREAKDLHFSSSAYHLDNRRPDLADLTLSQSNMDTEISTLTLSNELLLEHITRKTGGDSDALMESLSTYRQAIDTPYHQPYETIRQVIMTHDSTLSALSRNPEVMGQAEGASLLAILANISPELYNILTEEITEKNADALFAQNFSENITPENFASQSWIAKYYGLELSEVQKYLGMLQNGYSDSTSAYVDNISTGLVVNNESKLEAYKITRVKTDDYDKNINYFDLMYEGNNQFFIRANFKVSREFGATLRKNAGPSGIVGSLSGPLIANTNFKSNYLSNISDSEYKNGVKIYAYRYTSSTSATNQGGGIFTFESYPLTIFALKLNKAIRLCLTSGLSPNELQTIVRSDNAQGIINDSVLTKVFYTLFYSHRYALSFDDAQVLNGSVINQYADDDSVSHFNRLFNTPPLKGKIFEADGNTVSIDPDEEQSTFARSALMRGLGVNSGELYQLGKLAGVLDAQNTITLSVFVISSLYRLTLLARVHQLTVNELCMLYGLSPFNGKTTASLSSGELPRLVIWLYQVTQWLTEAEITTEAIWLLCTPEFSGNISPEISNLLNNLRPSISEDMAQSHNRELQAEILAPFIAATLHLASPDMARYILLWTDNLRPGGLDIAGFMTLVLKESLNANETTQLVQFCHVMAQLSLSVQTLRLSEAELSVLVISGFAVLGAKNQPAGQHNIDTLFSLYRFHQWINGLGNPGSDTLDMLRQQTLTADRLASVMGLDISMVTQAMVSAGVNQLQCWQDINTVLQWIDVASALHTMPSVIRTLVNIRYVTALNKAESNLPSWDEWQTLAENMEAGLSTQQAQTLADYTAERLSSVLCNWFLANIQPEGVSLHSRDDLYSYFLIDNQVSSAIKTTRLAEAIAGIQLYINRALNRIEPNARADVSTRQFFTDWTVNNRYSTWGGVSRLVYYPENYIDPTQRIGQTRMMDELLENISQSKLSRDTVEDAFKTYLTRFETVADLKVVSAYHDNVNSNTGLTWFVGQTRENLPEYYWCNVDISRMQAGELAANAWKEWTKIDTAVNPYKDAIRPVILRERLHLIWVEKEEVAKNGTDPVETCDRFTLKLAFLRHDGSWSAPWSYDITTQVEAVTDKKPDTERLALAASGFQGEDTLLVFVYKTGKSYSDFGGSNKNVAGMTIYGDGSFKKMENTALSRYSQLKNTFDIIHTQGNDLVRKASYRFAQDFEVPASLNMGSAIGDDSLTVMENGNIPQITSKYSSDNLAITLHNAAFTVRYDGSGNVIRNKQISAMKLTGVDGKSQYGNAFIIANTVKHYGGYSDLGGPITVYNKTKNYIASVQGHLMNADYTRRLILTPVENNYYARLFEFPFSPNTILNTVFTVGSNKTSDFKKCSYAVDGNNSQGFQIFSSYQSSGWLDIDTGINNTDIKITVMAGSKTHTFTASDHIASLPANSFDAMPYTFKPLEIDASSLAFTNNIAPLDIVFETKAKDGRVLGKIKQTLSVKRVNYNPEDILFLRETHSGAQYMQLGVYRIRLNTLLASQLVSRANTGIDTILTMETQRLPEPPLGEGFFANFVLPKYDPAEHGDERWFKIHIGNVGGNTGRQPYYSGMLSDTSETSMTLFVPYAEGYYMHEGVRLGVGYQKITYDNTWESAFFYFDETKQQFVLINDADHDSGMTQQGIVKNIKKYKGFLNVSIATGYSAPMDFNSASALYYWELFYYTPMMCFQRLLQEKQFDEATQWINYVYNPAGYIVNGEIAPWIWNCRPLEETTSWNANPLDAIDPDAVAQNDPMHYKIATFMRLLDQLILRGDMAYRELTRDALNEAKMWYVRTLELLGDEPEDYGSQQWAAPSLSGAASQTVQAAYQQDLTMLGRGGVSKNLRTANSLVGLFLPEYNPALTDYWQTLRLRLFNLRHNLSIDGQPLSLAIYAEPTDPKALLTSMVQASQGGSAVLPGTLSLYRFPVMLERTRNLVAQLTQFGTSLLSMAEHDDADELTTLLLQQGMELATQSIRIQQRTVDEVDADIAVLAESRRSAQNRLEKYQQLYDEDINHGEQRAMSLLDAAAGQSLAGQVLSIAEGVADLVPNVFGLACGGSRWGAALRASASVMSLSATASQYSADKISRSEAYRRRRQEWEIQRDNADGEVKQMDAQLESLKIRREAAQMQVEYQETQQAHTQAQLELLQRKFTNKALYSWMRGKLSAIYYQFFDLTQSFCLMAQEALRRELTDNGVTFIRGGAWNGTTAGLMAGETLLLNLAEMEKVWLERDERALEVTRTVSLAQFYQALSSDNFNLTEKLTQFLREGKGNVGASGNELKLSNRQIEASVRLSDLKIFSDYPESLGNTRQLKQVSVTLPALVGPYEDIRAVLNYGGSIVMPRGCSAIALSHGVNDSGQFMLDFNDSRYLPFEGISVNDSGSLTLSFPDATDRQKALLESLSDIILHIRYTIRSPRDRTRPTSMQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSDNKGQTIRTRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLDTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKR

SEQ ID NO: 61 - DNA, 7569 bp, Xenorhabdus nematophilus
atgataaaagttaatgaactgttagataagataaatagaaaaaggtctggtgatactttattattgacaaacatttcgtttatgtctttcagcgaatttcgtcataggacaagtggaactctgacgtggcgagaaacagactttttatatcaacaggctcatcaggaatcaaaacagaataaacttgaagaactgcgcattttgtcccgtgctaatccacaactggctaataccactaaccttaatattacaccgtcaaccctaaacaatagttacaacagttggttttatggccgtgcccaccgttttgtaaaaccgggatcaattgcttccatattttcaccagcggcttatttaacagaattatatcgggaagcgaaagattttcatcctgacaattctcaatatcacctgaataaacgacgccccgacattgcttcactggcactgacacagaataatatggatgaagaaatttccacattatccttatctaatgaattactgctgcataatattcagacgttagagaaaactgactataacggtgtaatgaaaatgttgtccacttaccggcaaaccggcatgacaccctatcatctgccgtatgagtcagcccgtcaggcaattttattgcaagataaaaacctcaccgcatttagccgtaatacagacgtagcggaattaatggacccaacatcgctactggctattaagactgatatatcgcctgaattgtatcaaatccttgtagaagaaattacaccggaaaattcaacagaactgatgaagaaaaatttcggtacagatgatgtactgatttttaagagttatgcttctttggctcgctactacgatttgtcttatgatgaactcagtttatttgtcaatctctccttcggtaagaaaaatacaaatcaacagtataagaatgagcaactgataacattggtcaatgacgggaatgatacggcaacggcaagattgattaagcgaacccgcaaagatttctacgattcacatttaaactatgcagaactaattccaatcaaagaaaatgaatacaaatataatttcagtgtaaaaaaaacagaacctgaccacttggattttcgtctccagaatggagataaagaatatatataccaagataaaaatttcgtccccattgctaatacccattacagtattcccattaaattgacgacagagcaaatcaccaacggtataacactccgcttatggcgagttaaaccaaatccgtcggatgctatcaatgccaatgcatactttaaaatgatggagttccccggtgatatattcctgttaaagctgaataaagcgattcgtttgtataaagccacaggcatatctccagaagatatctggcaagtaatagaaagtatttatgatgacttaaccattgacagcaatgtgttgggtaagctgttttatgttcaatattatatgcagcactataatattagcgtcagcgatgcgctggtattgtgtcattcagatatcagccaatattccactaaacaacaacccagtcattttacaatactgttcaatacaccgctattaaatggccaagagttttctgctgataataccaaactggatttaacccccggtgaatcaaaaaaccatttttatttgggaataatgaaacgtgctttcagagtgaatgatactgaactgtatacattatggaagctggctaatggcggaacaaatccagaatttatgtgttccatcgagaacctgtctctgctttatcgcgttcgtctgctggcagacattcatcatctgacagtgaatgaattatccatgttgttgtcggtttctccctatgtgaacacgaaaattgcccttttttctgatacagcattaacgcaattaatcagctttctgttccaatgcacccagtggctgacaacacagaaatggtctgtcagtgatgtgtttctgatgaccacggataattacagcactgtccttacgccggatattgaaaaccttatcacgacactaagtaatggattatcaacactttcactcggtgatgacgaactgatccgtgcagctgccccgctgattgctgccagcattcaaatggattcagccaagacagcagaaactattttgctgtggattaatcagataaaaccacaaggactgacattcgatgatttcatgattattgcggctaaccgtgatcgctcagagaatgaaaccagcaacatggtggctttttgtcaggtactggggcaactttctctgattgtgcgcaatattggactcagcgaaaacgaactgaccctgttggtgacaaaaccggagaaattccaatcagaaaccacagcactgcaacatgatctccccactttgcaagcgctgacccgcttccatgctgtgatcatgcgttgtggaagctacgcgacagaaatcttaacagcattggaactaggagcgctgactgccgaacaattggcggtggcgttaaaatttgatgctcaggttgtgacacaagcattgcaacagaccggtttgggagtgaatacctttaccaactggagaactatagatgtcactctgcaatggctggatgtcgctgctacattgggtattaccccggatggtgttgctgcactcataaaattaaaatatatcggtgaaccagaaaccccgatgccaacatttgatgattggcaagccgccagtactttgttgcaggcgggactgaacagtcaacaatccgaccagcttcaggcatggctggatgaagccacgacgacagcggccagtgcttactacatcaaaaatagtgcacctcaacagattaagagccgggatgagttgtacagctatctgctgattgataaccaagtttctgcccaagtgaaaaccacccgtgtggcagaagccattgccagcattcagttatatgtcaaccgggcgttgaataatgttgaaggaaaagtatcaaagccagtgaaaacccgtcagttcttctgcgactgggaaacctacaatcgacggtatagcacctgggccggcgtatctgaactggcctattatccggaaaactatatcgaccccacgattcgtattggtcagacaggtatgatgaacaacctgttacagcaactttcccaaagtcagttaaatatcgataccgttgaagatagctttaaaaattatctgaccgcatttgaagatgtcgctaacttgcaggtgattagcggatatcatgacagtatcaatgtcaatgagggactcacttatttaattggttatagccagacagaacccagaatatattattggcgcaatgtcgatcaccaaaagtgccagcacggtcaatttgctgccaatgcctggggagaatggaaaaaaattgaaatacccatcaatgtatggcaggaaaatatcagacctgttatttacaagtctcgtttgtatttactgtggctggaacaaaaagagctgaaaaatgaaagtgaagatggcaagatagatatcactgattatatattaaaactgtcacatattcgttatgatggcagctggagctcaccgtttaattttaatgtgactgataaaatagaaaacctgatcaataaaaaagccagcattggtatgtattgttcttctgattatgaaaaagacgtcattattgtttatttccatgagaaaaaagacaattattcttttaatagtcttcctgcaagagaagggatgaccattaaccctgatatgacattatccattctcacagaaaatgatttagacgccattgttaagagcacattatcagaacttgataccaggacagaatacaaagtcaacaatcaatttgctacagattatttggccgaatataaggaatctataaccacaaaaaataaattagccagttttaccggaaatatttttgatctctcgtatatatcaccaggaaatggtcatattaatttaacgttcaatccttcaatggaaattaatttttcaaaaggcaatatatataatgatgaggttaaatacctgttatcgatggtagaagatgaaacggttattttatttgattatgatagacatgatgaaatgcttggaaaagaagaagaagtttttcattatggaactttggattttattatttccatcgatcttaaaaatgccgaatattttagagtgttaatgcatctaagaaccaaggaaaaaattcctagaaaatcagaaattggagttggtataaattatgattatgaatcaaatgatgctgaattcaaacttgatactaacatagtattagattggaaagataacacaggagtatggcatactatatgtgaatcatttactaatgatgtttcaatcattaataacatgggaaatattgcggcactgttccttcgcgaggatccatgtgtgtatttatgttcaatagccacagatataaaaattgcttcatctatgatcgaacagatccaagataaaaacattagttttttattaaaaaatggctctgatattctagtggagttaaatgctgaagaccatgtggcatctaaaccttcacacgaatctgaccctatggtatatgattttaatcaagtaaaagttgatattgaaggctatgatattcctctggtgagcgagtttattattaagcaacccgacggcggttataacgatattgttattgaatcgccaattcatataaaactaaaatccaaagatacaagtaacgttatatcactgcataaaatgccatcaggcacacaatatatgcagattggcccttacagaacccggttaaatactttattttccagaaaattagctgaaagagccaatattggtattgataatgttttaagtatggaaacgcaaaatttaccagagccgcaattaggtgaagggttttatgcgacatttaagttgcccccctacaataaagaggagcatggtgatgaacgttggtttaagatccatattgggaatattgatggcaattctgccagacaaccttattacgaaggaatgttatctgatattgaaaccacagtaacgctctttgttccctatgctaaaggatattacatacgtgaaggtgtcagattaggggttgggtacaaaaaaattatctatgacaaatcctgggaatctgctttcttttattttgatgagacgaaaaatcaatttatattcattaatgatgccgatcatgattcgggaatgacacaacaggggatagtaaaaaatatcaaaaaatataaagggtttattcatgtcgttgtcatgaaaaataacactgaacccatggatttcaacggcgccaatgcaatctatttctgggaattgttctattacacgcccatgatggtattccagcgcttattgcaagagcagaattttaccgaatcgacacgctggctgcgctatatctggaacccggccggatattcggttcagggtgaaatgcaggattattactggaacgtccgcccattggaggaagatacgtcctggaatgccaatccgctggattcggtcgatcctgacgccgttgcccagcatgatccgatgcactataaagtggctacctttatgaaaatgctggatttgttgattacccgcggagatagcgcctatcgccagcttgaacgtgataccttaaacgaagctaaaatgtggtatgtacaggcgctcactttattgggtgatgagccttatttttcattggataacgattggtcagagccacggctggaagaagctgccagccaaacaatgcggcatcattatcaacataaaatgctgcaactgcgtcagcgcgctgcattacccacgaaacgtacggcaaattcgttaaccgcattgttcctccctcaaattaataaaaaactgcaaggttactggcagacattgacgcaacgcctctataacttacgccataacctgacaatcgacggtcagccactgtcattatctctctatgccacgcccgcagatccgtccatgttactcagtgctgccatcactgcttcacaaggcggcggcgatttacctcatgcagtgatgccgatgtaccgttttccggtgattctggaaaatgccaagtggggggtaagccagttgatacaatttggcaataccctgctcagcattactgaacggcaggatgcagaagccttggctgaaatactgcaaactcaaggcagtgagttagccctgcaaagtattaaaatgcaggataaggtcatggctgaaattgatgctgataaattggcgcttcaagaaagccgtcatggtgcacagtctcgttttgacagtttcaatacgctgtacgacgaagatgttaacgctggtgaaaaacaagcgatggatctttacctctcttcatcggtcttgagcaccagcggcacagccctgcatatggccgccgccgcggcagatctcgtccccaatatttacggttttgctgtgggaggttcccgttttggggcgcttttcaatgccagtgcgattggtatcgaaatttctgcgtcagcaacacgtattgccgcagacaaaatcagccaatcagaaatataccgtcgccgtcggcaagagtgggaaattcagcgcaataatgcggaagctgagataaaacaaattgatgctcaattagcgacgctggctgtacgtcgtgaagcggcagtattacaaaaaaactatctggaaactcagcaggcacaaactcaggcgcagttagcctttctgcaaagtaaattcagtaatgcagcgctatacaactggctccgtggaaggttgtccgctatttattatcagttttatgatttggcggtctcactctgtttaatggcagagcaaacttatcagtatgaattgaataatgcggcagcacactttattaaaccaggtgcctggcatgggacttatgcgggtttattagcgggtgaaaccctgatgctgaatttagcacagatggaaaaaagctatttggaaaaagatgaacgggcactggaggtcaccagaaccgtttctctggctgaagtgtatgctggtctgacagaaaatagtttcattttaaaagataaagtgactgagttagtcaatgcaggtgaaggcagtgcaggcacaacgcttaacggtttgaacgtcgaagggacacaactgcaagccagcctcaaattatcggatctgaatattgctaccgattatcctgacggtttaggtaatacacgccgtatcaaacaaatcagtgtgacattacctgcccttttagggccttatcaggatgttcgggcaatactaagttatggcggcagcacaatgatgccacgtggctgcaaagcgattgcgatctcacatggcatgaatgacagtggtcaattccagatggatttcaatgatgccaagtacctgccatttgaagggcttcctgtggccgatacaggcacattaaccctcagttttcccggtatcagtggtaaacagaaaagcttattgctcagcctgagcgatatcattctgcatatccgttacaccattcgttct

SEQ ID NO: 62 - DNA, 7614 bp, Xenorhabdus nematophilus
atgtatagcacggctgtattactcaataaaatcagtcccactcgcgacggtcagacgatgactcttgcggatctgcaatatttatccttcagtgaactgagaaaaatctttgatgaccagctcagttggggagaggctcgccatctctatcatgaaactatagagcagaaaaaaaataatcgcttgctggaagcgcgtatttttacccgtgccaacccacaattatccggtgctatccgactcggtattgaacgagacagcgtttcacgcagttatgatgaaatgtttggtgcccgttcttcttcctttgtgaaaccgggttcagtggcttccatgttttcaccggctggctatctcaccgaattgtatcgtgaagcgaaggacttacatttttcaagctctgcttatcatcttgataatcgccgtccggatctggctgatctgactctgagccagagtaatatggatacagaaatttccaccctgacactgtctaacgaactgttgctggagcatattacccgcaagaccggaggtgattcggacgcattgatggagagcctgtcaacttaccgtcaggccattgataccccttaccatcagccttacgagactatccgtcaggtcattatgacccatgacagtacactgtcagcgctgtcccgtaatcctgaggtgatggggcaggcggaaggggcttcattactggcgattctggccaatatttctccggagctttataacattttgaccgaagagattacggaaaagaacgctgatgctttatttgcgcaaaacttcagtgaaaatatcacgcccgaaaatttcgcgtcacaatcatggatagccaagtattatggtcttgaactttctgaggtgcaaaaatacctcgggatgttgcagaatggctattctgacagcacctctgcttatgtggataatatctcaacgggtttagtggtcaataatgaaagtaaactcgaagcttacaaaataacacgtgtaaaaacagatgattatgataaaaatataaattactttgatttgatgtatgaaggaaataatcagttctttatacgtgctaattttaaggtatcaagagaatttggggctactcttagaaaaaacgcagggccaagtggcattgtcggcagcctttccggtcctctaatagccaatacgaattttaaaagtaattatctaagtaacatatctgattctgaatacaaaaacggtgtaaagatatacgcctatcgctatacgtcttccaccagcgccacaaatcagggcggcggaatattcacttttgagtcttatcccctgactatatttgcgctcaaactgaataaagccattcgcttgtgcctgactagcgggctttcaccgaatgaactgcaaactatcgtacgcagtgacaatgcacaaggcatcatcaacgactccgttctgaccaaagttttctatactctgttctacagtcaccgttatgcactgagctttgatgatgcacaggtactgaacggatcggtcattaatcaatatgccgacgatgacagtgtcagtcattttaaccgtctctttaatacaccgccgctgaaagggaaaatctttgaagccgacggcaacacggtcagcattgatccggatgaagagcaatctacctttgcccgttcagccctgatgcgtggtctgggggtcaacagtggtgaactgtatcagttaggcaaactggcgggtgtgctggacgcccaaaataccatcacactttctgtcttcgttatctcttcactgtatcgcctcacgttactggcccgtgtccatcagctgacggtcaatgaactgtgtatgctttatggtctttcgccgttcaatggcaaaacaacggcttctttgtcttccggggagttgccacggctggttatctggctgtatcaggtgacgcagtggctgactgaggcggaaatcaccactgaagcgatctggttattatgtacgccagagtttagcgggaatatttcaccggaaatcagtaatctgctcaataacctccgaccgagtattagtgaagatatggcacagagtcacaatcgggagctgcaggctgaaattctcgcgccgtttattgctgcaacgctgcatctggcgtcaccggatatggcacggtatatcctgttgtggaccgataacctgcggccgggtggcttagatattgccgggtttatgacactggtattgaaagagtcgttaaatgccaatgaaaccacccaattggtacaattctgccatgtgatggcacagttatcgctttccgtacagacactgcgcctcagtgaagcggagctatccgtgctggtcatctccggattcgccgtgctgggggcaaaaaatcaacctgccggacagcacaatattgatacgctattctcactctaccgattccaccagtggattaatgggctgggcaatcccggctctgacacgctggatatgctgcgccagcagacactcacggccgacagactggcctccgtgatggggctggacatcagtatggtaacgcaggccatggtttccgccggcgtgaaccagcttcagtgttggcaggatatcaacaccgtgttgcagtggatagatgtggcatcagcactgcacacgatgccgtcggttatccgtacgctggtgaatatccgttacgtgactgcattaaacaaagccgagtcgaatctgccttcctgggatgagtggcagacactggcagaaaatatggaagccggactcagtacacaacaggctcagacgctggcggattataccgcggagcgcctgagtagcgtgctgtgcaattggtttctggcgaatatccagccagaaggggtgtccctgcacagccgggatgacctgtacagctatttcctgattgataatcaggtctcttctgccataaaaaccacccgactggcagaggccattgccggtattcagctctacatcaaccgggcgctgaatcggatagagcctaatgcccgtgccgatgtgtcaacccgccagttttttaccgactggacggtgaataaccgttacagcacctggggcggggtgtcgcggctggtttattatccggaaaattacattgacccaacccagcgtatcgggcagacccggatgatggatgaactgctggaaaatatcagccagagtaaacttagccgggacacagtggaggatgcctttaaaacttacctgacccgctttgaaaccgtggcggatctgaaagttgtcagcgcctatcacgacaacgtcaacagcaacaccggactgacctggtttgtcggccaaacgcgggagaacctgccggaatactactggcgtaacgtggatatatcacggatgcaggcgggtgaactggccgccaatgcctggaaagagtggacgaagattgatacagcggtcaacccctacaaggatgcaatacgtccggtcatattcagggaacgtttgcaccttatctgggtagaaaaagaggaagtggcgaaaaatggtactgatccggtggaaacctatgaccgttttactctgaaactggcgtttctgcgtcatgatggcagttggagtgccccctggtcttacgatatcacaacgcaggtggaggcggtcactgacaaaaaacctgacactgaacggctggcgctggccgcatcaggctttcagggcgaggacactctgctggtgtttgtctacaaaaccgggaagagttactcggattttggcggcagcaataaaaatgtggcaggcatgaccatttacggcgatggctccttcaaaaagatggagaacacagcactcagccgttacagccaactgaaaaatacctttgatatcattcatactcaaggcaacgacttggtaagaaaggccagctatcgtttcgcgcaggattttgaagtgcctgcctcgttgaatatgggttctgccatcggtgatgatagtctgacggtgatggagaacgggaatattccgcagataaccagtaaatactccagcgataaccttgctattacgctacataacgccgctttcactgtcagatatgatggcagtggcaatgtcatcagaaacaaacaaatcagcgccatgaaactgacgggggtggatggaaagtcccagtacggcaatgcatttatcatcgcaaataccgttaaacattatggcggttactctgatctgggggggccgatcaccgtttataataaaacgaaaaactatattgcatcagttcaaggccacttgatgaacgcagattacactaggcgtttgattctaacaccagttgaaaataattattatgccagattgttcgagtttccattttctccaaacacaattttaaacaccgttttcacggttggtagcaataaaaccagtgattttaaaaagtgcagttatgctgttgatggtaataattctcagggcttccagatatttagttcctatcaatcatccggctggctggatattgatacaggcattaacaataccgatatcaaaattacggtgatggctggcagtaaaacccacacctttacggccagtgaccatattgcttccttgccggcaaacagttttgatgctatgccgtacacctttaagccactggaaatcgatgcttcatcgttggcctttaccaataatattgctcctctggatatcgtttttgagaccaaagccaaagacgggcgagtgctgggtaagatcaagcaaacattatcggtgaaacgggtaaattataatccggaagatattctgtttctgcgtgaaactcattcgggtgcccaatatatgcagctcggggtgtatcgtattcgtcttaataccctgctggcttctcaactggtatccagagcaaacacgggcattgatactatcctgacaatggaaacccagcggttaccggaacctccgttgggagaaggcttctttgccaactttgttctgcctaaatatgaccctgctgaacatggcgatgagcggtggtttaaaatccatattgggaatgttggcggtaacacgggaaggcagccttattacagcggaatgttatccgatacgtcggaaaccagtatgacactgtttgtcccttatgccgaagggtattacatgcatgaaggtgtcagattgggggttggataccagaaaattacctatgacaacacttgggaatctgctttcttttattttgatgagacaaaacagcaatttgtattaattaacgatgctgatcatgattcaggaatgacgcaacaggggatcgtgaaaaatatcaagaaatacaaaggatttttgaatgtttctatcgcaacgggctattccgccccgatggatttcaatagtgccagcgccctctattactgggaattgttctattacaccccgatgatgtgcttccagcgtttgctacaggaaaaacaattcgacgaagccacacaatggataaactacgtctacaatcccgccggctatatcgttaacggagaaatcgccccctggatctggaactgccggccgctggaagagaccacctcctggaatgccaatccgctggatgccatcgatccggatgccgtcgcccaaaatgacccaatgcactacaagattgccacctttatgcgcctgttggatcaacttattctgcgcggcgatatggcctatcgagaactgacccgcgatgcgttgaatgaagccaaaatgtggtatgtgcgtactttagaattgctcggtgatgagccggaggattacggtagccaacagtgggcagcaccgtccctttccggggcggcgagtcaaaccgtgcaggcggcttatcagcaggatcttacgatgctgggccgtggtggggtttccaagaatctccgtaccgctaactcgttggtgggtttgttcctgccggaatataacccggcgctcaccgattactggcaaaccctgcgtttgcgcctgtttaacctgcgccataatctttccattgacggacagccgttatcgctggcgatttacgccgagcctaccgatccgaaagcgctgctcaccagtatggtacaggcctctcagggcggtagtgcagtgctgcccggcacattgtcgttataccgcttcccggtgatgctggagcggacccgcaatctggtagcgcaattaacccagttcggcacctctctgctcagtatggcagagcatgatgatgccgatgaactcaccacgctgctactacagcagggtatggaactggcgacacagagcatccgtattcagcaacgaactgtcgatgaagtggatgctgatattgctgtattggcagagagccgccgcagtgcacaaaatcgtctggaaaaataccagcagctgtatgacgaggatatcaaccacggagaacagcgggcaatgtcactgcttgatgcagcggcaggtcagtctctggccgggcaggtgctttcaatagcggaaggggtggccgatttagtgccaaacgtgttcggtttagcttgtggcggcagtcgttggggggcagcactgcgtgcttccgcctccgtgatgtcgctttctgccacagcttcccaatattccgcagacaaaatcagccgttcggaagcctaccgccgccgccgtcaggagtgggaaattcagcgtgataatgctgacggtgaagtcaaacaaatggatgcccagttggaaagcctgaaaatccgccgcgaagcagcacagatgcaggtggaatatcaggagacccagcaggcccatactcaggctcagttagagctgttacagcgtaaattcacaaacaaagcgctttacagttggatgcgcggcaagctgagtgctatctattaccagttctttgacctgacccagtccttctgcctgatggcacaggaagcgctgcgccgcgagctgaccgacaacggtgttacctttatccggggtggggcctggaacggtacgactgcgggtttgatggcgggtgaaacgttgctgctgaatctggcagaaatggaaaaagtctggctggagcgtgatgagcgggcactggaagtgacccgtaccgtctcgttggcacagttctatcaggccttatcatcagacaactttaatctgaccgaaaaactcacgcaattcctgcgtgaagggaaaggcaacgtaggagcttccggcaatgaattaaaactcagtaaccgtcagatagaagcctcagtgcgattgtctgatttgaaaattttcagcgactaccccgaaagccttggcaatacccgtcagttgaaacaggtgagtgtcaccttgccggcgctggttgggccgtatgaagatattcgggcggtgctgaattacgggggcagcatcgtcatgccacgcggttgcagtgctattgctctctcccacggcgtgaatgacagtggtcaatttatgctggatttcaacgattcccgttatctgccgtttgaaggtatttccgtgaatgacagcggcagcctgacgttgagtttcccggatgcgactgatcggcagaaagcgctgctggagagcctgagcgatatcattctgcatatccgctataccattcgttct

SEQ ID NO: 63 - DNA, 7515 bp, Photorhabdus luminescens
atgcaaaactcattatcaagcactatcgatactatttgtcagaaactgcaattaacttgtccggcggaaattgctttgtatccctttgatactttccgggaaaaaactcggggaatggttaattggggggaagcaaaacggatttatgaaattgcacaagcggaacaggatagaaacctacttcatgaaaaacgtatttttgcctatgctaatccgctgctgaaaaacgctgttcggttgggtacccggcaaatgttgggttttatacaaggttatagtgatctgtttggtaatcgtgctgataactatgccgcgccgggctcggttgcatcgatgttctcaccggcggcttatttgacggaattgtaccgtgaagccaaaaacttgcatgacagcagctcaatttattacctagataaacgtcgcccggatttagcaagcttaatgctcagccagaaaaatatggatgaggaaatttcaacgctggctctctctaatgaattgtgccttgccgggatcgaaacaaaaacaggaaaatcacaagatgaagtgatggatatgttgtcaacttatcgtttaagtggagagacaccttatcatcacgcttatgaaactgttcgtgaaatcgttcatgaacgtgatccaggatttcgtcatttgtcacaggcacccattgttgctgctaagctcgatcctgtgactttgttgggtattagctcccatatttcgccagaactgtataacttgctgattgaggagatcccggaaaaagatgaagccgcgcttgatacgctttataaaacaaactttggcgatattactactgctcagttaatgtccccaagttatctggcccggtattatggcgtctcaccggaagatattgcctacgtgacgacttcattatcacatgttggatatagcagtgatattctggttattccgttggtcgatggtgtgggtaagatggaagtagttcgtgttacccgaacaccatcggataattataccagtcagacgaattatattgagctgtatccacagggtggcgacaattatttgatcaaatacaatctaagcaatagttttggtttggatgatttttatctgcaatataaagatggttccgctgattggactgagattgcccataatccctatcctgatatggtcataaatcaaaagtatgaatcacaggcgacaatcaaacgtagtgactctgacaatatactcagtatagggttacaaagatggcatagcggtagttataattttgccgccgccaattttaaaattgaccaatactccccgaaagctttcctgcttaaaatgaataaggctattcggttgctcaaagctaccggcctctcttttgctacgttggagcgtattgttgatagtgttaatagcaccaaatccatcacggttgaggtattaaacaaggtttatcgggtaaaattctatattgatcgttatggcatcagtgaagagacagccgctattttggctaatattaatatctctcagcaagctgttggcaatcagcttagccagtttgagcaactatttaatcacccgccgctcaatggtattcgctatgaaatcagtgaggacaactccaaacatcttcctaatcctgatctgaaccttaaaccagacagtaccggtgatgatcaacgcaaggcggttttaaaacgcgcgtttcaggttaacgccagtgagttgtatcagatgttattgatcactgatcgtaaagaagacggtgttatcaaaaataacttagagaatttgtctgatctgtatttggttagtttgctggcccagattcataacctgactattgctgaattgaacattttgttggtgatttgtggctatggcgacaccaacatttatcagattaccgacgataatttagccaaaatagtggaaacattgttgtggatcactcaatggttgaagacccaaaaatggacagttaccgacctgtttctgatgaccacggccacttacagcaccactttaacgccagaaattagcaatctgacggctacgttgtcttcaactttgcatggcaaagagagtctgattggggaagatctgaaaagagcaatggcgccttgcttcacttcggctttgcatttgacttctcaagaagttgcgtatgacctgctgttgtggatagaccagattcaaccggcacaaataactgttgatgggttttgggaagaagtgcaaacaacaccaaccagcttgaaggtgattacctttgctcaggtgctggcacaattgagcctgatctatcgtcgtattgggttaagtgaaacggaactgtcactgatcgtgactcaatcttctctgctagtggcaggcaaaagcatactggatcacggtctgttaaccctgatggccttggaaggttttcatacctgggttaatggcttggggcaacatgcctccttgatattggcggcgttgaaagacggagccttgacagttaccgatgtagcacaagctatgaataaggaggaatctctcctacaaatggcagctaatcaggtggagaaggatctaacaaaactgaccagttggacacagattgacgctattctgcaatggttacagatgtcttcggccttggcggtttctccactggatctggcagggatgatggccctgaaatatgggatagatcataactatgctgcctggcaagctgcggcggctgcgctgatggctgatcatgctaatcaggcacagaaaaaactggatgagacgttcagtaaggcattatgtaactattatattaatgctgttgtcgatagtgctgctggagtacgtgatcgtaacggtttatatacctatttgctgattgataatcaggtttctgccgatgtgatcacttcacgtattgcagaagctatcgccggtattcaactgtacgttaaccgggctttaaaccgagatgaaggtcagcttgcatcggacgttagtacccgtcagttcttcactgactgggaacgttacaataaacgttacagtacttgggctggtgtctctgaactggtctattatccagaaaactatgttgatcccactcagcgcattgggcaaaccaaaatgatggatgcgctgttgcaatccatcaaccagagccagctaaatgcggatacggtggaagatgctttcaaaacttatttgaccagctttgagcaggtagcaaatctgaaagtaattagtgcttaccacgataatgtgaatgtggatcaaggattaacttattttatcggtatcgaccaagcagctccgggtacgtattactggcgtagtgttgatcacagcaaatgtgaaaatggcaagtttgccgctaatgcttggggtgagtggaataaaattacctgtgctgtcaatccttggaaaaatatcatccgtccggttgtttatatgtcccgcttatatctgctatggctggagcagcaatcaaagaaaagtgatgatggtaaaaccacgatttatcaatataacttaaaactggctcatattcgttacgacggtagttggaatacaccatttacttttgatgtgacagaaaaggtaaaaaattacacgtcgagtactgatgctgctgaatctttagggttgtattgtactggttatcaaggggaagacactctattagttatgttctattcgatgcagagtagttatagctcctataccgataataatgcgccggtcactgggctatatattttcgctgatatgtcatcagacaatatgacgaatgcacaagcaactaactattggaataacagttatccgcaatttgatactgtgatggcagatccggatagcgacaataaaaaagtcataaccagaagagttaataaccgttatgcggaggattatgaaattccttcctctgtgacaagtaacagtaattattcttggggtgatcacagtttaaccatgctttatggtggtagtgttcctaatattacttttgaatcggcggcagaagatttaaggctatctaccaatatggcattgagtattattcataatggatatgcgggaacccgccgtatacaatgtaatcttatgaaacaatacgcttcattaggtgataaatttataatttatgattcatcatttgatgatgcaaaccgttttaatctggtgccattgtttaaattcggaaaagacgagaactcagatgatagtatttgtatatataatgaaaacccttcctctgaagataagaagtggtatttttcttcgaaagatgacaataaaacagcggattataatggtggaactcaatgtatagatgctggaaccagtaacaaagatttttattataatctccaggagattgaagtaattagtgttactggtgggtattggtcgagttataaaatatccaacccgattaatatcaatacgggcattgatagtgctaaagtaaaagtcaccgtaaaagcgggtggtgacgatcaaatctttactgctgataatagtacctatgttcctcagcaaccggcacccagttttgaggagatgatttatcagttcaataacctgacaatagattgtaagaatttaaatttcatcgacaatcaggcacatattgagattgatttcaccgctacggcacaagatggccgattcttgggtgcagaaacttttattatcccggtaactaaaaaagttctcggtactgagaacgtgattgcgttatatagcgaaaataacggtgttcaatatatgcaaattggcgcatatcgtacccgtttgaatacgttattcgctcaacagttggttagccgtgctaatcgtggcattgatgcagtgctcagtatggaaactcagaatattcaggaaccgcaattaggagcgggcacatatgtgcagcttgtgttggataaatatgatgagtctattcatggcactaataaaagctttgctattgaatatgttgatatatttaaagagaacgatagttttgtgatttatcaaggagaacttagcgaaacaagtcaaactgttgtgaaagttttcttatcctattttatagaggcgactggaaataagaaccacttatgggtacgtgctaaataccaaaaggaaacgactgataagatcttgttcgaccgtactgatgagaaagatccgcacggttggtttctcagcgacgatcacaagacctttagtggtctctcttccgcacaggcattaaagaacgacagtgaaccgatggatttctctggcgccaatgctctctatttctgggaactgttctattacacgccgatgatgatggctcatcgtttgttgcaggaacagaattttgatgcggcgaaccattggttccgttatgtctggagtccatccggttatatcgttgatggtaaaattgctatctaccactggaacgtgcgaccgctggaagaagacaccagttggaatgcacaacaactggactccaccgatccagatgctgtagcccaagatgatccgatgcactacaaggtggctacctttatggcgacgttggatctgctaatggcccgtggtgatgctgcttaccgccagttagagcgtgatacgttggctgaagctaaaatgtggtatacacaggcgcttaatctgttgggtgatgagccacaagtgatgctgagtacgacttgggctaatccaacattgggtaatgctgcttcaaaaaccacacagcaggttcgtcagcaagtgcttacccagttgcgtctcaatagcagggtaaaaaccccgttgctaggaacagccaattccctgaccgctttattcctgccgcaggaaaatagcaagctcaaaggctactggcggacactggcgcagcgtatgtttaatttacgtcataatctgtcgattgacggccagccgctctccttgccgctgtatgctaaaccggctgatccaaaagctttactgagtgcggcggtttcagcttctcaagggggagccgacttgccgaaggcgccgctgactattcaccgcttccctcaaatgctagaaggggcacggggcttggttaaccagcttatacagttcggtagttcactattggggtacagtgagcgtcaggatgcggaagctatgagtcaactactgcaaacccaagccagcgagttaatactgaccagtattcgtatgcaggataaccaattggcagagctggattcggaaaaaaccgccttgcaagtctctttagctggagtgcaacaacggtttgacagctatagccaactgtatgaggagaacatcaacgcaggtgagcagcgagcgctggcgttacgctcagaatctgctattgagtctcagggagcgcagatttcccgtatggcaggcgcgggtgttgatatggcaccaaatatcttcggcctggctgatggcggcatgcattatggtgctattgcctatgccatcgctgacggtattgagttgagtgcttctgccaagatggttgatgcggagaaagttgctcagtcggaaatatatcgccgtcgccgtcaagaatggaaaattcagcgtgacaacgcacaagcggagattaaccagttaaacgcgcaactggaatcactgtctattcgccgtgaagccgctgaaatgcaaaaagagtacctgaaaacccagcaagctcaggcgcaggcacaacttactttcttaagaagcaaattcagtaatcaagcgttatatagttggttacgagggcgtttgtcaggtatttatttccagttctatgacttggccgtatcacgttgcctgatggcagagcaatcctatcaatgggaagctaatgataattccattagctttgtcaaaccgggtgcatggcaaggaacttacgccggcttattgtgtggagaagctttgatacaaaatctggcacaaatggaagaggcatatctgaaatgggaatctcgcgctttggaagtagaacgcacggtttcattggcagtggtttatgattcactggaaggtaatgatcgttttaatttagcggaacaaatacctgcattattggataagggggagggaacagcaggaactaaagaaaatgggttatcattggctaatgctatcctgtcagcttcggtcaaattgtccgacttgaaactgggaacggattatccagacagtatcgttggtagcaacaaggttcgtcgtattaagcaaatcagtgtttcgctacctgcattggttgggccttatcaggatgttcaggctatgctcagctatggtggcagtactcaattgccgaaaggttgttcagcgttggctgtgtctcatggtaccaatgatagtggtcagttccagttggatttcaatgacggcaaatacctgccatttgaaggtattgctcttgatgatcagggtacactgaatcttcaatttccgaatgctaccgacaagcagaaagcaatattgcaaactatgagcgatattattttgcatattcgttataccatccgttaa

SEQ ID NO: 64 - DNA, 7551 bp, Photorhabdus luminescens
atgaacgagtctgtaaaagagatacctgatgtattaaaaagccagtgtggttttaattgtctgacagatattagccacagctcttttaatgaatttcgccagcaagtatctgagcacctctcctggtccgaaacacacgacttatatcatgatgcacaacaggcacaaaaggataatcgcctgtatgaagcgcgtattctcaaacgcgccaatccccaattacaaaatgcggtgcatcttgccattctcgctcccaatgctgaactgataggctataacaatcaatttagcggtagagccagtcaatatgttgcgccgggtaccgtttcttccatgttctcccccgccgcttatttgactgaactttatcgtgaagcacgcaatttacacgcaagtgactccgtttattatctggatacccgccgcccagatctcaaatcaatggcgctcagtcagcaaaatatggatatagaattatccacactctctttgtccaatgagctgttattggaaagcattaaaactgaatctaaactggaaaactatactaaagtgatggaaatgctctccactttccgtccttccggcgcaacgccttatcatgatgcttatgaaaatgtgcgtgaagttatccagctacaagatcctggacttgagcaactcaatgcatcaccggcaattgccgggttgatgcatcaagcctccctattgggtattaacgcttcaatctcgcctgagctatttaatattctgacggaggagattaccgaaggtaatgctgaggaactttataagaaaaattttggtaatatcgaaccggcctcattggctatgccggaataccttaaacgttattataatttaagcgatgaagaacttagtcagtttattggtaaagccagcaattttggtcaacaggaatatagtaataaccaacttattactccggtagtcaacagcagtgatggcacggttaaggtatatcggatcacccgcgaatatacaaccaatgcttatcaaatggatgtggagctatttcccttcggtggtgagaattatcggttagattataaattcaaaaatttttataatgcctcttatttatccatcaagttaaatgataaaagagaacttgttcgaactgaaggcgctcctcaagtcaatatagaatactccgcaaatatcacattaaataccgctgatatcagtcaaccttttgaaattggcctgacacgagtacttccttccggttcttgggcatatgccgccgcaaaatttaccgttgaagagtataaccaatactcttttctgctaaaacttaacaaggctattcgtctatcacgtgcgacagaattgtcacccacgattctggaaggcattgtgcgcagtgttaatctacaactggatatcaacacagacgtattaggtaaagtttttctgactaaatattatatgcagcgttatgctattcatgctgaaactgccctgatactatgcaacgcgcctatttcacaacgttcatatgataatcaacctagccaatttgatcgcctgtttaatacgccattactgaacggacaatatttttctaccggcgatgaggagattgatttaaattcaggtagcaccggcgattggcgaaaaaccatacttaagcgtgcatttaatattgatgatgtctcgctcttccgcctgcttaaaattaccgaccatgataataaagatggaaaaattaaaaataacctaaagaatctttccaatttatatattggaaaattactggcagatattcatcaattaaccattgatgaactggatttattactgattgccgtaggtgaaggaaaaactaatttatccgctatcagtgataagcaattggctaccctgatcagaaaactcaatactattaccagctggctacatacacagaagtggagtgtattccagctatttatcatgacctccaccagctataacaaaacgctaacgcctgaaattaagaatttgctggataccgtctaccacggtttacaaggttttgataaagacaaagcagatttgctacatgtcatggcgccctatattgcggccaccttgcaattatcatcggaaaatgtcgcccactcggtactcctttgggcagataagttacagcccggcgacggcgcaatgacagcagaaaaattctgggactggttgaatactaagtatacgccgggttcatcggaagccgtagaaacgcaggaacatatcgttcagtattgtcaggctctggcacaattggaaatggtttaccattccaccggcatcaacgaaaacgccttccgtctatttgtgacaaaaccagagatgtttggcgctgcaactggagcagcgcccgcgcatgatgccctttcactgattatgctgacacgttttgcggattgggtgaacgcactaggcgaaaaagcgtcctcggtgctagcggcatttgaagctaactcgttaacggcagaacaactggctgatgccatgaatcttgatgctaatttgctgttgcaagccagtattcaagcacaaaatcatcaacatcttcccccagtaactccagaaaatgcgttctcctgttggacatctatcaatactatcctgcaatgggttaatgtcgcacaacaattgaatgtcgccccacagggcgtttccgctttggtcgggctggattatattcaatcaatgaaagagacaccgacctatgcccagtgggaaaacgcggcaggcgtattaaccgccgggttgaattcacaacaggctaatacattacacgcttttctggatgaatctcgcagtgccgcattaagcacctactatatccgtcaagtcgccaaggcagcggcggctattaaaagccgtgatgacttgtatcaatacttactgattgataatcaggtttctgcggcaataaaaaccacccggatcgccgaagccattgccagtattcaactgtacgtcaaccgggcattggaaaatgtggaagaaaatgccaattcgggggttatcagccgccaattctttatcgactgggacaaatacaataaacgctacagcacttgggcgggtgtttctcaattagtttactacccggaaaactatattgatccgaccatgcgtatcggacaaaccaaaatgatggacgcattactgcaatccgtcagccaaagccaattaaacgccgataccgtcgaagatgcctttatgtcttatctgacatcgtttgaacaagtggctaatcttaaagttattagcgcatatcacgataatattaataacgatcaagggctgacctattttatcggactcagtgaaactgatgccggtgaatattattggcgcagtgtcgatcacagtaaattcaacgacggtaaattcgcggctaatgcctggagtgaatggcataaaattgattgtccaattaacccttataaaagcactatccgtccagtgatatataaatcccgcctgtatctgctctggttggaacaaaaggagatcaccaaacagacaggaaatagtaaagatggctatcaaactgaaacggattatcgttatgaactaaaattggcgcatatccgctatgatggcacttggaatacgccaatcacctttgatgtcaataaaaaaatatccgagctaaaactggaaaaaaatagagcgcccggactctattgtgccggttatcaaggtgaagatacgttgctggtgatgttttataaccaacaagacacactagatagttataaaaacgcttcaatgcaaggactatatatctttgctgatatggcatccaaagatatgaccccagaacagagcaatgtttatcgggataatagctatcaacaatttgataccaataatgtcagaagagtgaataaccgctatgcagaggattatgagattccttcctcggtaagtagccgtaaagactatggttggggagattattacctcagcatggtatataacggagatattccaactatcaattacaaagccgcatcaagtgatttaaaaatctatatctcaccaaaattaagaattattcataatggatatgaaggacagaagcgcaatcaatgcaatctgatgaataaatatggcaaactaggtgataaatttattgtttatactagcttgggggtcaatccaaataactcgtcaaataagctcatgttttaccccgtctatcaatatagcggaaacaccagtggactcaatcaagggagactactattccaccgtgacaccacttatccatctaaagtagaagcttggattcctggagcaaaacgttctctaaccaaccaaaatgccgccattggtgatgattatgctacagactctctgaataaaccggatgatcttaagcaatatatctttatgactgacagtaaagggactgctactgatgtctcaggcccagtagagattaatactgcaatttctccagcaaaagttcagataatagtcaaagcgggtggcaaggagcaaacttttaccgcagataaagatgtctccattcagccatcacctagctttgatgaaatgaattatcaatttaatgcccttgaaatagacggttctggtctgaattttattaacaactcagccagtattgatgttacttttaccgcatttgcggaggatggccgcaaactgggttatgaaagtttcagtattcctgttaccctcaaggtaagtaccgataatgccctgaccctgcaccataatgaaaatggtgcgcaatatatgcaatggcaatcctatcgtacccgcctgaatactctatttgcccgccagttggttgcacgcgccaccaccggaatcgatacaattctgagtatggaaactcagaatattcaggaaccgcagttaggcaaaggtttctatgctacgttcgtgatacctccctataacctatcaactcatggtgatgaacgttggtttaagctttatatcaaacatgttgttgataataattcacatattatctattcaggccagctaacagatacaaatataaacatcacattatttattcctcttgatgatgtcccattgaatcaagattatcacgccaaggtttatatgaccttcaagaaatcaccatcagatggtacctggtggggccctcactttgttagagatgataaaggaatagtaacaataaaccctaaatccattttgacccattttgagagcgtcaatgtcctgaataatattagtagcgaaccaatggatttcagcggcgctaacagcctctatttctgggaactgttctactataccccgatgctggttgctcaacgtttgctgcatgaacagaacttcgatgaagccaaccgttggctgaaatatgtctggagtccatccggttatattgtccacggccagattcagaactaccagtggaacgtccgcccgttactggaagacaccagttggaacagtgatcctttggattccgtcgatcctgacgcggtagcacagcacgatccaatgcactacaaagtttcaacttttatgcgtaccttggatctattgatagcacgcggcgaccatgcttatcgccaactggaacgagatacactcaacgaagcgaagatgtggtatatgcaagcgctgcatctattaggtgacaaaccttatctaccgctgagtacgacatggagtgatccacgactagacagagccgcggatatcactacccaaaatgctcacgacagcgcaatagtcgctctgcggcagaatatacctacaccggcacctttatcattgcgcagcgctaataccctgactgatctcttcctgccgcaaatcaatgaagtgatgatgaattactggcagacattagctcagagagtatacaatctgcgtcataacctctctatcgacggccagccgttatatctgccaatctatgccacaccggccgatccgaaagcgttactcagcgccgccgttgccacttctcaaggtggaggcaagctaccggaatcatttatgtccctgtggcgtttcccgcacatgctggaaaatgcgcgcggcatggttagccagctcacccagttcggctccacgttacaaaatattatcgaacgtcaggacgcggaagcgctcaatgcgttattacaaaatcaggccgccgagctgatattgactaacctgagcattcaggacaaaaccattgaagaattggatgccgagaaaacggtgttggaaaaatccaaagcgggagcacaatcgcgctttgatagctacggcaaactgtacgatgagaatatcaacgccggtgaaaaccaagccatgacgctacgagcgtccgccgccgggcttaccacggcagttcaggcatcccgtctggccggtgcggcggctgatctggtgcctaacatcttcggctttgccggtggcggcagccgttggggggctatcgctgaggcgacaggttatgtgatggaattctccgcgaatgttatgaacaccgaagcggataaaattagccaatctgaaacctaccgtcgtcgccgtcaggagtgggagatccagcggaataatgccgaagcggaattgaagcaaatcgatgctcagctcaaatcactcgctgtacgccgcgaagccgccgtattgcagaaaaccagtctgaaaacccaacaagaacagacccaatctcaattggccttcctgcaacgtaagttcagcaatcaggcgttatacaactggctgcgtggtcgactggcggcgatttacttccagttctacgatttggccgtcgcgcgttgcctgatggcagaacaagcttaccgttgggaactcaatgatgactctgcccgcttcattaaaccgggcgcctggcagggaacctatgccggtctgcttgcaggtgaaaccttgatgctgagtctggcacaaatggaagacgctcatctgaaacgcgataaacgcgcattagaggttgaacgcacagtatcgctggccgaagtttatgcaggattaccaaaagataacggtccattttccctggctcaggaaattgacaagctggtgagtcaaggttcaggcagtgccggcagtggtaataataatttggcgttcggcgccggcacggacactaaaacctctttgcaggcatcagtttcattcgctgatttgaaaattcgtgaagattacccggcatcgcttggcaaaattcgacgtatcaaacagatcagcgtcactttgcccgcgctactgggaccgtatcaggatgtacaggcaatattgtcttacggcgataaagccggattagctaacggctgtgaagcgctggcagtttctcacggtatgaatgacagcggccaattccagctcgatttcaacgatggcaaattcctgccattcgaaggcatcgccattgatcaaggcacgctgacactgagcttcccaaatgcatctatgccggagaaaggtaaacaagccactatgttaaaaaccctgaacgatatcattttgcatattcgctacaccattaaataa

SEQ ID NO: 65 - DNA, 7500 bp, Photorhabdus luminescens
atgaacacactcaaatccgaatatcaacaagcgttaggagcaggttttaataatctaaccgatatctgccatctctcttttgacgaactgcgcaaaaaagtgaaggataaactctcatggtcacagacccagagcttatatcttgaagcacagcaggtgcaaaaggataaccttctgcatgaagcccgtattctgaaacgcgcaaaccctcatttacaaagtgcggtccatcttgccctgacagcacctcatgcagaccagcaaggttataatagccgatttggcaatcgcgccagcaaatatgcagcccctggcgcaatttcctccatgttttctcttgcggcttatctgactgaactttatcgtcaggcacgaaatttacatgcagaaggttccatttatcatctggatacgcgtcgcccagatctaaaatcattggtgctcagccagaaaaatatgaatacggagatttccacgctttctctgtctaataacatgttgctaaacagtattaagactcagcctaatctgaacagccacgctaaagtgatggaaaagttatcaactttccgcacttctggctcaatgccatatcacgatgcttatgaaagtgtacgtaagattattcaattacaagctcctgtgtttgaacaatccagtacattaacagatacgccaatcaccaaactgatgtatcaaatctccttgctggggattaatgcctctgtctcaccggagctgtttactattctgacgcaaaagataaaaccagcaaccaatgctgataacactaatgaactaaaaaaactttataagaagaattttggtgaaattaaatctattcaaatggcaagggcagaatacctgaaaagttattataatctgacagacaaagaacttaaccagtttagtaaaaagattaaacaaatagatagcctgtggaatataggagacgagattacccaataccatctattgaaattcaataaagctattaatctatctcgatcaaccgagctatcaccaataatccttaacagcattgccatcgatatccttaaaaaaacacctccagaggatgactctgacaacccttttagggacgaccctgattaccttgaaagctttcaagaccttgaccttagtgacgaaccagatatagacgaagatgtattaagagaagctttacgtgttaaagactatatgcaacgttatggtattgatgctgagactgcattaatactgtgcaaagcacccatttcagaaaatccttctcatcccgatctatccaaattactagcagacatccatcaattaactattgatgaattaggggtactactggttgccatagatgaaggaaaaaccgatttatctcagattactcatgacaatttagcggttctaattagcaaactctattccgttaccaattggctgcgtacacggaaatggagtgtatatcagttatttgtaatgacgaccgataaatataacaaaaccttaaccccggaaataaacaaccttctggataccgtctacaatggcttgcagaacttttacaaggataatttgctaaaaataaaagataatctattgaaagccaaagaaagtttaccagaagacaaagataatdtgccgaaagcmgagcaakatstgttggaagccgagaaatatctgctagcagccgagaaatatctgctagcagccgagaaatatctattggaagccaataaaaatccgctagaagccaaaaaggctctgaaagaatacgagaaaaatcaggaggcatacgagaaaaatctgaaagaacacgagaaatatctgttgaaagccggagaaaatctgccagcaatcaaagagaatttgctaaaaatcaaggaaaatctgccaaaagccatatctccttatatcgccgccgctctgcaattgccatctgagaatgttgctctctccgtgctggcttgggcagataaactaaactctggcaaagaaaacaaaatgacggcagattcattctggaactggttacggaaaaaacccattgaaactcaatcgaaaacaactgaagcaactgaagcaactgaagcaactgaagcaactgaagcaactgaagcaactgaaaaaactacactaattcaacaagctgtccaatattgccagtgcctagcacaactggcgctgatttatcgctctaccggtcttagcgaaagcactttacgtctgtttgtgacaaatccacaaatctttggtcttaccgcgaaaacaacgtcaacacacaatgtattatcactgattatgctgacgcgttttactgactgggttaactcactaggtgaaaacgcctcttctgtactgaccgagtttgaaaaaggaacattaacggcagaactattggctaacgccatgaatcttgataaaaatctactagagcaagccagtactcaagcacaagctgatttctccaattggccatctatcgacaacctattgcagtggattaacatctcgcgtcaattgaacatctcgccacaaggcgtttctgaactggcgaaaatattagacatagaatcttctactaattatgcccaatgggaaaatgtcgcttcaatattaaccgccggactagatacccaaaaagccaataccctacatgcatttctgggtgagtctcgcagtactgcgttaagtacatactatatttattctcataaccaaaaagatcgagaagaaagaaaacatacggtaattaaagaccgtgatgatctatatcaatacctgttgatcgataaccaagtctccgccgccatcaaaaccacggagattgctgaagctatcgctagtatccaactgtatattaaccgcgcattgaaaaatatggagggagataccgacacaagtgtcactagccgtttattcttcactaactgggataaatacaacaaacgctacagcacctgggctggtattactaagctcctttactaccctgaaaactatatcgatccgacactgcggatcggccagacaaaaatgatggatacgctactgcaatccatcagccaaagtcaattgaataccgataccgtagaagatgcctttaaatcttatctaacgtcattcgaacaagtggctaatctggaagtcatcagcgcctatcatgacaatattaataatgaccaaggattgacctattttatcggacgcagtaaaacagaagtgaatcaatattattggcgcagtgtagatcacaataaattcagcgaaggtaaattccccgctaatgcctggagcgagtggcacaaaattgactgcccaattaatccctacgaagatactatccgcccggtagtctaccaatcccgcctgtatattatctggctggaacagaagaaggtaactaatcgagcagaaggagaagctatcaaacaaggaagcaaaacgaccacaagctatcattatgaactgaaattggcacatattcgttatgacggcacctggaatacaccaattacctttgatgtagatgaaaaaatatctggtctaaatttagaactgaataaagcgttagggctctattgtgcaagttatcaaggcaaagataaattgctggttatgttttataaaaaacaggagcaattaaataattacacagaaaaaacaggaaacacatacacagcaccaataaaagggctatatatcacttccaatatgtctcctgaggaaatgacacccgaaagttacagacttaatgctcataaacagtttgataccaacaatgtcgtaagagtcaataaccgctatgcagaaagctacgaaatcccttcatcagtaaacagtaataatggttatgattggggagagggctatctgagtatggtatacggcgggagcattctgattacccgtgacccaagcgataactcaaaaatccaaatctcaccaaagttaagaattattcataatggatatgaaggtcgacaacgtaatcaatgcaatttgatgaagaaatacggcaagctcggtgataaattcattatttatactacgctaggtattaaccccaataatttatcaaataaaaaacttatctaccctgtttatcaatatgaaggaaatgaaagtaagcttagtcaaggaagacttctgttttatcgggatagcaccactaactttacaagagcctggttccctaacctttcttctgactcaaaagaaatgtccataaccactggcggtaacattagtggtaattatggttatattgataacaaacatagtgacaacaaaccattcgaagaatatttctatatggacgaccacggcggtattgacactgacgtttcggagccaatatttattaatacaaaaattcagccttcaaatgttaaaatcatagtgaaaacagtgaaggatgatggaaaattagacagtaaaccatatatagcagaagacaaagtttcagttaaaccgacaccaaactttgaagaaatgtgttatcagtttaataatctcgatcaaatagatgtctccactctagtatttaaaaataatgaagcaagtattgatatcacctttacagcatctgctgacgcatttgaaagtggtaaagaacaacgtaatctaggtgaagaacatttcagtattcgtattatcaaaaaagcgaatgttaatgatgtcctgacccttcaccacgatccaagtggggcacaatatatgcaatggggagcctatcgtactcgccttaataccctgtttgcccgtaaattaattagccgcgccaatgcggggatcgacactattttgagtatggaaactcagaatattcaagagccacaattaggcaaaggcttttatgttaatttcactcttcctaaatatgatcaaaacacacatggtaatgaacgccagtttaaaattcatatagggaatattgctggtgataatacaatgcggccatattaccaaggaatattggctgacaccgaaaccagtgtcgttctttttgtcccttatgagaaacaatcttataccaatgaaggtgttagattaggagttgaatacaaaaaagtatcttacctaggcgtctgggaacccgctttcttctatttcaatgaaattcaacagaagtttattctgattaatgatgccgatcataactcagcaatgactcaatctggtgaaaaaacaggaattaaaaaatacaaaggctttcttgacgtttctattcttatcgatcatcagcacacagaaccaatggacttcaacggcgccaacagcctctacttctgggaactgttctactataccccgatgctgatcgctcaacgtttgctacacgagcaaaatttcgatgaagctaaccgttggctgaaatatgtctggaatccatctggtcatattgccaatggtcaaaaacagcacccccacaactggaatgtccgcccattacaagaggacaccagttggaacgatgatccattggatacatttgatcccgatgccatcgctcaacatgatccgatgcactacaaagtcgccacctttatgtgcgcccttgatctattgatcgaacagggagattacgcctatcgccagttggaacgggacacactcgccgaagccaaaatgtggtatatgcaggcactgcatctattaggcgataaacctcatttattactcagttcaacatggagtgatccagagctaaaagaagccgcagatcttgaaaaacaacaggcacatgccaaagcaatagcagatttacgacaaggccagcctaaagatggaagcaacacagatcttttcctgccacaggtcaacgaagtgatgttgagctattggcagaaactggaacaacggttatataacctgcgccataacctctctattgatggtcaacctttacatttgcctattttcgcgacaccggcagatccaaaagcgctgctcagcgccgctgtcgccagttcacaaggtggaagcaatcttccgtcagagtttatatcagtttggcgtttcccacatatgctggaaaacgcccgcagtatggtcagtcaactcacccaattcggctccacattacaaaatattatcgaacgtcaggatgcggaagcattaaacacgctgttacagaatcaagcggcggaactgatattgaccaatctcagcatacaggacaaaaccattgaagagctggatgttgaaaaaactgtgctagaaaaaacccgcgccggagctaaatcgcgttttgatagctacagcaaattctacgatgaagatatcaacgcaggtgaaaaacaggcgatggcgttgcgagcctccgtcgcaggcatctctactgcacttcaagcatcacatctggcaggcgcagcgcttgatttggctcccaacatctttggcttcgctgatggcggtagccattggggagcaattgcccaagccacaagtaatgtcatggaattctccgccagtgtcatgagcaccgaagcggataaaatcagccagtctgaagcctaccgtcggcgtcgacaggagtggaaaatccagcgtaacaacgctgatgcagagttgaaacaaatcgatgctcaacttcaatcattagtcgtacgccgtgaagccgccgtgttgcagaaaaccagcctgaaaacccaacaagagcagacgcacgcacaactgaccttcctgcaacataagttcagcaatcaggcattatacaactggctgcgtggtcggctgtccgccatttacttccagttctatgatttagcggtagcccgttgcctgatggctgaaatggcctatcgttgggagactaacgatgccgcagcacgctttatcaagcccggcgcctggcagggaacccatgccggtctgctggcgggtgaaaccttaatgctgaatctagcacagatggaagatgcccacctgaaacaggagcaacgcgtactggaggtagaacgtaccgtttcactagcagaagtttataaagagaaaggtcaattttctctgaccaagaaaattgcagaactggtgaataagaaaccagacactaccagtagcagaaataacacactgaattttggtgaaggaaatgccaaaacttctctacaagcgtctatttcgttagctgacttacaaattcgtcacgattacccagaaaacagtggagccggtaacgtccgccggattaaacagatcagtgtcaccctgccggcactgttaggaccttatcaggatgtgcaagcgattctgtcttatggcggagatgccaccgggttagccaaaggttgtaaagcgctggcagtttctcacggaatgaatgacagcggtcagttccaattggatttcaacgatggcaaattcctgccatttgaaggaatcgaaatcgataaaggtacgctgacattaagcttcccgaatgcaaccgaaaaacaaaaaaccatgctggagagtataagcgacatcattctgcatattcgctacaccattcgccaataa

SEQ ID NO: 66 - DNA, 7146 bp, Photorhabdus luminescens
atgaactcatacgtgaaagagatacctgatgtattacaaagccaatatggtattaattgtctgacagatatttgccactattcttttaatgaatttcgtcagcaagtctctgatcatctctcctggtcagagaccaaccgcttatatcgtgatgcacaacaggaacaaaaagagaatcaattatatgaagctcgtattcttaaacgcgctaacccgcagttgcaaaatgcagtgcacctcggtattaccctccctcatgctgaattacgaggctataatagtgaattcggtggccgagccagccaatatgtggcgccgggttcggtttcctctatgttctcccccgcagcttatttaactgaactctatcgtgaagcacgtaatttacatgccagcgactccgtttatcatctggatgaacgccgcccagacctccaatcaatgacgctcagccagcaaaatatggataccgaactttccactctttctctgtctaatgaaattttgttgaaaggaattaaagctaatcagtctaatctggacagcgatactaaggtgatggaaatgttatccactttccgtccttccggcacgataccttatcatgatgcttacgaaaatgtacgtaaagctatccaattacaagatccgaaacttgaacaatttcagaaatcaccggcggtcgccggattaatgcatcaagcttcattattaggaattaataactctatctcaccagaactgtttaatattctgacagaagagattaccgaagctaacgcagaggcaatttataaacagaattttggcgatattgaccctgcctgcctggcaatgccggaatatctgaaaagttattataattttagtgatgaagaactcagtcaatttattcgcaaatatccagataatgaactaaatactcagaaaatacatttactaaaaatcaataaaattattttattatcgcaagccgtgaatctgccgtttttaaagttagatgaaattattccagaacagaacattaccccgacagtattagggaaaatctttctagttaaatattatatgcagaaatacaatattggtacggaaactgccttaatattatgtaatgattccatttcacaatactcctatagtaatcaacctagccaatttgatcgcctatttaatacctcgccactcaatggacaatatttcgttatcgaagacactaatattgacctaagtctgaacagtaccgataactggcacaaagcagtacttaaacgtgcttttaatgtcgatgatatttccctctatcgtttactccatattgccaatcataacaataccgatggaaaaattgctaataatataaaaaatctttccaatctttatatgactaaactactggcagatattcatcaattaacgattgatgaactgtatttactactgataactattggtgaagataaaataaatttatatgatattgatgataaagagctggagaaactcataaacagactcgataccctaagcaattggctgcatacacaaaagtggagtatctatcagttatttttgatgaccaccaccaactatgacaaaacactaacgcctgaaattcaaaacttactcgatacggtctacaatggcttacagaacttcgataaaaataaaaccaaacttctggcagccatcgcgccttatattgctgcaacactacaattaccatctgaaaatgtcgcacattctattcttctctgggctgataagataaaaccaagcgaaaataaaataacggcagaaaaattttggatctggttacaaaatagagatactacagaattgtcaaaaccgccagaaatgcaggaacaaattattcagtactgccactgtctggcacaattgacaatgatttatcgttcttccggcattaatgaaaacgctttccgtctatttatcgaaaagccaactatttttggcatccctgatgaaccgaataaagcgacaccagcccataatgcaccaacattaatcatcctaacccgctttgccaattgggttaattctctaggtgaaaaagcctcccctattctaacggcttttgaaaataaaaccttaactgcggaaaaattagctaacgccatgaatcttgatgctaatttactggaacaagccagtattcaagcacaaaattataagcaggttactaaagaaaatacattctccaattggcaatccatcgacattattctgcaatggactaatatagccagtaatttaaatatctccccacaaggtatttcccctctaatagcattggattatataaaaccggctcaaaaaacaccgacttatgcccaatgggaaaatgcagctatagcattaactgccgggttagacactcaacaaactcatactctacacgtatttctggacgaatctcgcagtaccgcattaagcaactattatattggcaaggttgctaatcgggcagcatcaattaaaagccgtgacgatttataccaatacttactgattgataatcaagtttccgctgaaataaaaactacacgtattgccgaagccattgccagtatccaattgtatgtcaaccgagcgctggaaaatatagaaatccatgccgtttctgatgttattacccgtcaattttttatcgattgggataaatataataaacgttacagtacttgggctggcgtttcacaattagtttactatcccgaaaattatatcgacccgacgatgcgtatcggacaaacgaaaatgatggatacgttattgcaatccgtcagccagagccaattaaatgccgatacggtagaagatgcatttaaatcttacctgacctcgtttgaacaagtcgctaatttggaagtcattagtgcttatcatgataacgttaataatgaccaaggactgacctattttatcgggaacagcaaaacagaagttaatcaatattactggcgcagcgtcgatcacagtaaattcaacgacggtaaattcgctgctaatgcctggagtgaatggcacaaaattgactgcgcaattaatccctaccaaagcaccattcgcccagttatctataaatcccgattatatctgatttggctggaacaaaaagaaacagctaaacaaaaggaggataataaagtcactacagactatcactatgaattaaaattggctcatattcgttatgatggtacctggaatgtgccaatcacctttgatgtagatgaaaaaatactagctttagaactgacaaaatctcaagcacctggactctattgcgcaggttatcaaggggaagatacactattaatcatgttttatagaaaaaaagagaaattggatgattataaaactgcaccaatgcaaggattttatattttctccgatatgtcttccaaagatatgaccaatgaacaatgcaattcttatcgagataacggttatacacatttcgatactaattctgatactaatagcgtcataagaataaataatcgctatgcagaggattatgaaattccttcattgatcaatcatagcaatagccatgattggggggaatataatcttagccaggtatatggcggaaatatagttatcaattacaaagttacatcaaatgatttgaaaatctatatttcaccaaaattaagaataatccatgatggaaaagaaggtcgagagcgcattcagtctaatctaataaagaaatacggcaaattgggtgataaattcattatttatactagtttgggaatcaatccgaataattcatcaaatagattcatgttttacccagtctatcaatataatggaaacactagcggccttgctcaagggagactattattccatcgagacacgagttattcatctaaagtagcggcttggattcctggggcaggacgttctttaatcaatgaaaatgctaacatcggtgatgattgtgctgaagattctgtgaataaaccggatgatcttaagcaatacatctatatgactgacagtaaagggactgctactgatgtttccgggccagtagatatcaacacagcaatttcttctgaaaaggttcaaatcacaattaaagctggcaaagaatactctcttacagcgaataaagatgtctccgttcagccatcacctagctttgaagaaatgtgttaccaatttaatgctctcgaaatagatggctctaatctgaattttactaacaattcagccagtattgatgtcacttttaccgcactggcagatgatggacgcaaattgggttatgaaattttcaatatccctgttattcaaaaggttaaaaccgataatgctctaactctttttcatgacgagaatggcgctcaatatatgcaatggggagcctatcgcattcgccttaatacgctatttgctcgccaattagttgaacgagctaatactggtattgatacaattctaagtatggaaactcagaatattcaggaaccgatgatgggaataggcgcttatatagaactcattttggataaatataatcctgatatccacggcactaataaatcatttaagattatatatggtgatatttttaaagcaggtgatcattttcctatttatcagggagcattaagcgatattacacaaacaacagtaaaattattcttacctcgcgttgataacgcttatggaaataaaaacaatctctatgtttacgcggcctatcaaaaagtggaaacaaatttcattcgattcgttaaagaggataataataaacccgctacattcgacactacctataagaatgggaccttcccagggcttgcatcagccagagtaatacaaactgtctcggaaccaatggatttcagcggcgctaatagtctctacttctgggaactgttctactataccccgatgatggttgctcaacgtttgctacatgaacaaaactttgatgaagccaaccgttggctaaaatatgtctggagcccatccggttatattgttcgaggtcaaattaaaaactaccactggaatgtgcgcccattactggaaaacaccagttggaacagtgatcctttggattccgtcgatcctgacgcagtggcacagcacgatccaatgcactataaagtagccacctttatgcgtactctcgatctactgatggcacgcggcgatcacgcctatcgccaacttgagcgggatacgctgaacgaagccaaaatgtggtatatgcaagcactgcacctgttgggcaataaaccctatctgcctctgagttctgtatggaatgatccacgtctggacaatgccgcagccactaccacacaaaaagcacacgcctacgcaataacctctctacggcaaggcacgcaaacaccagcattattattgcgctccgctaataccctgaccgatcttttcctgccacaaatcaacgacgttatgttgagctactggaacaaactggaactgcgtctgtataacttacgtcataatctctctatcgatggtcagcctctccacctaccgatttacgccacaccggccgatccgaaagcgttactcagcgccgccgttgctacttctcaaggcggcggcaaactaccagagtcatttatatcactgtggcgcttcccgcatatgttggaaaatgcccgtagtatggtcactcagctaatacagttcggctccacgttgcaaaatattattgaacgccaagatgctgaatccttaaatgctctgctgcaaaatcaagccaaagagttgattttgacaacgctcagcattcaagacaaaaccatcgaagaaatagatgctgaaaaaactgtgctggaaaaatccaaagccggagcaaaatcgcgctttgacaactacagcaaattatatgacgaagatgtcaacgccggtgagcgtcaagctctggatatgcgaatagcttcccaaagtattacctcaggattgaaaggcttgcacatggctgccgccgcactggagatggtgcccaatatctacggctttgcagtcggggggacgcgctatggagcaattgccaatgccattgcgattggtggcggtatcgccgcagaaggtttgttaattgaagcagagaaagtctcgcaatctgaaatatggcgccgtcgccgtcaagagtgggaaatccagcgtaataatgccgaagcagagatgaaacaaatcgatgctcaacttaaatcactaacggtacgccgtgaagcggcggtattacagaaaaccggcctaaaaacccaacaggaacaaactcaagcgcaactagctttcctgcaacgaaaattcagcaatcaagcgctgtataattggttacgtggtcggttagcagccatttatttccaattttacgatttagtcgtcgcccgttgtttgatggcagaacaagcttaccgttgggaaactaatgatagctctgcacgctttattaaaccgggagcctggcagggaacctatgccggcctgctcgccggagaaaccctaatgttgaacctggcgcaaatggaagacgcgcacctgaaacaagagcaacgcgcactggaagtggaacgcacggtttctctggcgcaggtgtaccaatccttaggggagaaaagctttgcattaaaagataaaattgaagcgttgctacaaggagataaagagacttccgccggtaacgacggcaatcaattgaaattaaccaacaatacgctatccgcgacgctaaccctgcaagatctgaaactcaaagatgactacccggaagagatgcagttaggtaaaacacgccgcattaaacaaattagcgtctccttaccggcattattgggaccgtatcaagatgttcaggctgtcctgtcttatggtggcgatgccaccgggctagctaaaggttgtaaagccttggcggtctcccacggcctgaatgacaacggtcagtttcagctcgattttaacgatggcaaattcctgccgtttgaagggatcgatattaatgacaaagggacattcacgctaagtttccccaatgccgccagtaaacaaaaaaatatattacagatgctgaccgatattattctgcacattcgttacactattctcgaataa

SEQ ID NO: 67 - DNA, 15067 bp, Artificial Sequence
  8836 "BCA" triple fusion polynucleotide sequence
tctagactgagtcgacgcactactagtaacaaagaaggagatataccatgcaaaattcacaagattttagtattacggaactgtcactgcccaaaggggggggcgctatcacgggaatgggtgaagcattaacccccactggaccggatggtatggccgcgctatctctaccattgcctatttctgccgggcgcggttatgctcccgcattcactctgaattacaacagcggcgccggtaacagtccatttggtctgggttgggattgcaacgttatgactatccgccgccgcacccattttggcgtcccccattatgacgaaaccgatacctttttggggccagaaggcgaagtgctggtggtagcggatcaacctcgcgacgaatccacattacagggtatcaatttaggcgccacctttaccgttaccggctaccgttcccgtctggaaagccatttcagccgattggaatattggcaacccaaaacaacaggtaaaacagatttttggttgatatatagcccagatgggcaggtgcatctactgggtaaatcaccgcaagcgcggatcagcaacccatcccaaacgacacaaacagcacaatggctgctggaagcctctgtatcatcacgtggcgaacaaatttattatcaatatcgcgccgaagatgacacaggttgcgaagcagatgaaattacgcaccatttacaggctacagcgcaacgttatttacacatcgtgtattacggcaaccgtacagccagcgaaacattacccggtctggatggcagcgccccatcacaagcagactggttgttctatctggtatttgattacggcgaacgcagtaacaacctgaaaacgccaccagcattttcgactacaggtagctggctttgccgtcaggaccgtttttcccgttatgaatatggctttgagattcgtacccgccgcttatgccgtcaggtattgatgtaccatcacctgcaagcactggatagtaagataacagaacacaacggaccaacgctggtttcacgcctgatactcaattacgacgaaagcgcgatagccagcacgctagtattcgttcgccgagtgggacacgagcaagatggtaatgtcgtcaccctgccgccattagaattggcatatcaggatttttcaccgcgacatcacgctcactggcaaccaatggatgtactggcaaacttcaatgccattcagcgctggcagctagtcgatctaaaaggcgaaggattacccggcctgttatatcaggataaaggcgcttggtggtaccgctccgcacagcgtctgggcgaaattggctcagatgccgtcacttgggaaaagatgcaacctttatcggttattccttctttgcaaagtaatgcctcgttggtggatatcaatggagacggccaacttgactgggttatcaccggaccgggattacggggatatcatagtcaacgcccggatggcagttggacacgttttaccccactcaacgctctgccggtggaatacacccatccacgcgcgcaactcgcagatttaatgggagccgggctatccgatttggtgctgatcggccctaagagcgtgcgtttatatgccaatacccgcgacggctttgccaaaggaaaagatgtggtgcaatccggtgatatcacactgccggtgccgggcgccgatccacgtaagttggtggcgtttagtgatgtattgggttcaggtcaagcccatctggttgaagtaagcgcgactaaagtcacctgctggcctaatctggggcgcggacgttttggtcaacccattaccttaccgggattcagccagccagcaaccgagtttaacccggctcaagtttatctggccgatctggatggcagcggtccaacggatctgatttatgttcatacaaaccgtctggatatcttcctgaacaaaagtggcaatggctttgctgaaccagtgacattacgcttcccggaaggtctgcgttttgatcatacctgtcagttacaaatggccgatgtacaaggattaggcgtcgccagcctgatactgagcgtgccgcatatgtctccccatcactggcgctgcgatctgaccaacatgaagccgtggttactcaatgaaatgaacaacaatatgggggtccatcacaccttgcgttaccgcagttcctcccaattctggctggatgaaaaagccgcggcgctgactaccggacaaacaccggtttgctatctccccttcccgatccacaccctatggcaaacggaaacagaagatgaaatcagcggcaacaaattagtcacaacacttcgttatgctcgtggcgcatgggacggacgcgagcgggaatttcgcggatttggttatgtagagcagacagacagccatcaactggctcaaggcaacgcgccagaacgtacgccaccggcgctgaccaaaaactggtatgccaccggactgccggtgatagataacgcattatcaaccgagtattggcgtgatgatcaggcttttgccggtttctcaccgcgctttacgacttggcaagataacaaagatgtcccgttaacaccggaagatgataacagtcgttactggttcaaccgcgcgttgaaaggtcaactgctacgtagtgaactgtacggattggacgatagtacaaataaacacgttccctatactgtcactgaatttcgttcacaggtacgtcgattacagcataccgacagccgataccctgtactttggtcatctgtagttgaaagccgcaactatcactacgaacgtatcgccagcgacccgcaatgcagtcaaaatattacgctatccagtgatcgatttggtcagccgctaaaacagctttcggtacagtacccgcgccgccagcagccagcaatcaatctgtatcctgatacattgcctgataagttgttagccaacagctatgatgaccaacaacgccaattacggctcacctatcaacaatccagttggcatcacctgaccaacaataccgttcgagtattgggattaccggatagtacccgcagtgatatctttacttatggcgctgaaaatgtgcctgctggtggtttaaatctggaacttctgagtgataaaaatagcctgatcgcggacgataaaccacgtgaatacctcggtcagcaaaaaaccgcttataccgatggacaaaatacaacgccgttgcaaacaccaacacggcaagccctgattgcctttaccgaaacaacggtattcaaccagtccacattatcagcgtttaacggaagcatcccgtccgataaattatcaacgacgctggagcaagctggatatcagcaaacaaattatctattccctcgcactggagaagataaagtttgggtagcccatcacggctataccgattatggtacagcggcacagttctggcgcccgcaaaaacagagcaacacccaactcaccggtaaaatcaccctcatctgggatgcaaactattgcgttgtggtacaaacccgggatgctgctggactgacaacctcagccaaatatgactggcgttttctgaccccggtgcaactcaccgatatcaatgacaatcagcaccttatcacactggatgcattgggccgaccaatcacattgcgcttttggggaactgaaaacggcaagatgacaggttattcctcaccggaaaaagcatcattttctccaccatccgatgttaatgccgctattgagttaaaaaaaccgctccctgtagcacagtgtcaggtctacgcaccagaaagctggatgccagtattaagtcagaaaaccttcaatcgactggcagaacaagattggcaaaagttatataacgcccgaatcatcaccgaagatggacgtatctgcacactggcttatcgccgctgggtacaaagccaaaaggcaatccctcaactcattagcctgttaaacaacggaccccgtttacctcctcacagcctgacattgacgacggatcgttatgatcacgatcctgagcaacagatccgtcaacaggtggtattcagtgatggctttggccgcttgctgcaagccgctgcccgacatgaggcaggcatggcccggcaacgcaatgaagacggctctttgattataaatgtccagcatactgagaaccgttgggcagtgactggacgaacggaatatgacaataaggggcaaccgatacgtacctatcagccctatttcctcaatgactggcgatacgtcagcaatgatagtgcccggcaggaaaaagaagcttatgcagatacccatgtctatgatcccataggtcgagaaatcaaggttatcaccgcaaaaggttggttccgtcgaaccttgttcactccctggtttactgtcaatgaagatgaaaatgacacagccgctgaggtgaagaaggtaaagatgccgggatccgacaacaagggtcagactatccgcactaggcctatgaaaaacatcgatcccaaactttatcaaaaaacccctactgtcagcgtttacgataaccgtggtctgataatccgtaacatcgattttcatcgtactaccgcaaatggtgatcccgatacccgtattacccgccatcaatacgatattcacggacacctaaatcaaagcatcgatccgcgcctatatgaagccaagcaaaccaacaatacgatcaaacccaattttctttggcagtatgatttgaccggtaatcccctatgtacagagagcattgatgcaggtcgcactgtcaccttgaatgatattgaaggccgtccgctactaacggtgactgcaacaggggttatacaaactcgacaatatgaaacttcttccctgcccggtcgtctgttatctgttgccgaacaaacacccgaggaaaaaacatcccgtatcaccgaacgcctgatttgggctggcaataccgaagcagagaaagaccataaccttgccggccagtgcgtgcgtcactatgacacggcgggagttacccggttagagagtttatcactgaccggtactgttttatctcaatccagccaactattgatcgacactcaagaggcaaactggacaggtgataacgaaaccgtctggcaaaacatgctggctgatgacatctacacaaccctgagcaccttcgatgccaccggtgctttactgactcagaccgatgcgaaagggaacattcagagactggcttatgatgtggccgggcagctaaacgggagctggctaacactcaaaggccagacggaacaagtgattatcaaatccctgacctactccgccgccggacaaaaattacgtgaggaacacggcaatgatgttatcaccgaatacagttatgaaccggaaacccaacggctgatcggtatcaaaacccgccgtccgtcagacactaaagtgctacaagacctgcgctatgaatatgacccggtaggcaatgtcatcagcatccgtaatgacgcggaagccacccgcttttggcacaatcagaaagtgatgccggaaaacacttatacctacgattccctgtatcagcttatcagcgccaccgggcgcgaaatggcgaatataggtcaacaaagtcaccaatttccctcacccgctctaccttctgataacaacacctataccaactatacccgtacttatacttatgaccgtggcggcaatctgaccaaaatccagcacagttcaccggcgacgcaaaacaactacaccaccaatatcacggtttcaaatcgcagcaaccgcgcagtactcagcacattgaccgaagatccggcgcaagtagatgctttgtttgatgcaggcggacatcagaacaccttgatatcaggacaaaacctgaactggaatactcgtggtgaactgcaacaagtaacactggttaaacgggacaagggcgccaatgatgatcgggaatggtatcgttatagcggtgacggaagaaggatgttaaaaatcaatgaacagcaggccagcaacaacgctcaaacacaacgtgtgacttatttgccgaacttagaacttcgtctaacacaaaacagcacggccacaaccgaagatttgcaagttatcaccgtaggcgaagcgggccgggcacaggtacgagtattacattgggagagcggtaaaccggaagatatcgacaataatcagttgcgttatagttacgataatcttatcggttccagtcaacttgaattagatagcgaaggacaaattatcagtgaagaagaatattatccctatggtggaacagcattatgggccgccaggaatcagacagaagccagttataaaactatccgttattcaggcaaagagcgggatgccaccgggctatattactacggctatcggtattaccaaccgtggataggacggtggttaagctccgatccggcaggaacaatcgatgggctgaatttatatcggatggtgaggaataatccagttaccctccttgatcctgatggattaatgccaacaattgcagaacgcatagcagcactaaaaaaaaataaagtaacagactcagcgccttcgccagcaaatgccacaaacgtagcgataaacatccgcccgcctgtagcaccaaaacctagcttaccgaaagcatcaacgagtagccaaccaaccacacaccctatcggagctgcaaacataaaaccaacgacgtctgggtcatctattgttgctccattgagtccagtaggaaataaatctacttctgaaatctctctgccagaaagcgctcaaagcagttcttcaagcactacctcgacaaatctacagaaaaaatcatttactttatatagagcagataacagatcctttgaagaaatgcaaagtaaattccctgaaggatttaaagcctggactcctctagtcactaagatggcaaggcaatttgctagtatctttattggtcagaaagatacatctaatttacctaaagaaacagtcaagaacataagcacatggggagcaaagccaaaactaaaagatctctcaaattacataaaatataccaaggacaaatctacagtatgggtttctactgcaattaatactgaagcaggtggacaaagctcaggggctccactccataaaattgatatggatctctacgagtttgccattgatggacaaaaactaaatccactaccggagggtagaactaaaaacatggtaccttcccttttactcgacaccccacaaatagagacatcatccatcattgcacttaatcatggaccggtaaatgatgcagaaatttcatttctgacaacaattccgcttaaaaatgtaaaacctcataagagacctagggataataaaggccaaaccattcgtacccgtccagaattcatgtatagcacggctgtattactcaataaaatcagtcccactcgcgacggtcagacgatgactcttgcggatctgcaatatttatccttcagtgaactgagaaaaatctttgatgaccagctcagttggggagaggctcgccatctctatcatgaaactatagagcagaaaaaaaataatcgcttgctggaagcgcgtatttttacccgtgccaacccacaattatccggtgctatccgactcggtattgaacgagacagcgtttcacgcagttatgatgaaatgtttggtgcccgttcttcttcctttgtgaaaccgggttcagtggcttccatgttttcaccggctggctatctcaccgaattgtatcgtgaagcgaaggacttacatttttcaagctctgcttatcatcttgataatcgccgtccggatctggctgatctgactctgagccagagtaatatggatacagaaatttccaccctgacactgtctaacgaactgttgctggagcatattacccgcaagaccggaggtgattcggacgcattgatggagagcctgtcaacttaccgtcaggccattgataccccttaccatcagccttacgagactatccgtcaggtcattatgacccatgacagtacactgtcagcgctgtcccgtaatcctgaggtgatggggcaggcggaaggggcttcattactggcgattctggccaatatttctccggagctttataacattttgaccgaagagattacggaaaagaacgctgatgctttatttgcgcaaaacttcagtgaaaatatcacgcccgaaaatttcgcgtcacaatcatggatagccaagtattatggtcttgaactttctgaggtgcaaaaatacctcgggatgttgcagaatggctattctgacagcacctctgcttatgtggataatatctcaacgggtttagtggtcaataatgaaagtaaactcgaagcttacaaaataacacgtgtaaaaacagatgattatgataaaaatataaattactttgatttgatgtatgaaggaaataatcagttctttatacgtgctaattttaaggtatcaagagaatttggggctactcttagaaaaaacgcagggccaagtggcattgtcggcagcctttccggtcctctaatagccaatacgaattttaaaagtaattatctaagtaacatatctgattctgaatacaaaaacggtgtaaagatatacgcctatcgctatacgtcttccaccagcgccacaaatcagggcggcggaatattcacttttgagtcttatcccctgactatatttgcgctcaaactgaataaagccattcgcttgtgcctgactagcgggctttcaccgaatgaactgcaaactatcgtacgcagtgacaatgcacaaggcatcatcaacgactccgttctgaccaaagttttctatactctgttctacagtcaccgttatgcactgagctttgatgatgcacaggtactgaacggatcggtcattaatcaatatgccgacgatgacagtgtcagtcattttaaccgtctctttaatacaccgccgctgaaagggaaaatctttgaagccgacggcaacacggtcagcattgatccggatgaagagcaatctacctttgcccgttcagccctgatgcgtggtctgggggtcaacagtggtgaactgtatcagttaggcaaactggcgggtgtgctggacgcccaaaataccatcacactttctgtcttcgttatctcttcactgtatcgcctcacgttactggcccgtgtccatcagctgacggtcaatgaactgtgtatgctttatggtctttcgccgttcaatggcaaaacaacggcttctttgtcttccggggagttgccacggctggttatctggctgtatcaggtgacgcagtggctgactgaggcggaaatcaccactgaagcgatctggttattatgtacgccagagtttagcgggaatatttcaccggaaatcagtaatctgctcaataacctccgaccgagtattagtgaagatatggcacagagtcacaatcgggagctgcaggctgaaattctcgcgccgtttattgctgcaacgctgcatctggcgtcaccggatatggcacggtatatcctgttgtggaccgataacctgcggccgggtggcttagatattgccgggtttatgacactggtattgaaagagtcgttaaatgccaatgaaaccacccaattggtacaattctgccatgtgatggcacagttatcgctttccgtacagacactgcgcctcagtgaagcggagctatccgtgctggtcatctccggattcgccgtgctgggggcaaaaaatcaacctgccggacagcacaatattgatacgctattctcactctaccgattccaccagtggattaatgggctgggcaatcccggctctgacacgctggatatgctgcgccagcagacactcacggccgacagactggcctccgtgatggggctggacatcagtatggtaacgcaggccatggtttccgccggcgtgaaccagcttcagtgttggcaggatatcaacaccgtgttgcagtggatagatgtggcatcagcactgcacacgatgccgtcggttatccgtacgctggtgaatatccgttacgtgactgcattaaacaaagccgagtcgaatctgccttcctgggatgagtggcagacactggcagaaaatatggaagccggactcagtacacaacaggctcagacgctggcggattataccgcggagcgcttgagtagcgtgctgtgcaattggtttctggcgaatatccagccagaaggggtgtccctgcacagccgggatgacctgtacagctatttcctgattgataatcaggtctcttctgccataaaaaccacccgactggcagaggccattgccggtattcagctctacatcaaccgggcgctgaatcggatagagcctaatgcccgtgccgatgtgtcaacccgccagttttttaccgactggacggtgaataaccgttacagcacctggggcggggtgtcgcggctggtttattatccggaaaattacattgacccaacccagcgtatcgggcagacccggatgatggatgaactgctggaaaatatcagccagagtaaacttagccgggacacagtggaggatgcctttaaaacttacctgacccgctttgaaaccgtggcggatctgaaagttgtcagcgcctatcacgacaacgtcaacagcaacaccggactgacctggtttgtcggccaaacgcgggagaacctgccggaatactactggtgtaacgtggatatatcacggatgcaggcgggtgaactggccgccaatgcctggaaagagtggacgaagattgatacagcggtcaacccctacaaggatgcaatacgtccggtcatactcagggaacgtttgcaccttatctgggtagaaaaagaggaagtggcgaaaaatggtactgatccggtggaaacctgtgaccgttttactctgaaactggcgtttctgcgtcatgatggcagttggagtgccccctggtcttacgatatcacaacgcaggtggaggcggtcactgacaaaaaacctgacactgaacggctggcgctggccgcatcaggctttcagggcgaggacactctgctggtgtttgtctacaaaaccgggaagagttactcggattttggcggcagcaataaaaatgtggcaggcatgaccatttacggcgatggctccttcaaaaagatggagaacacagcactcagccgttacagccaactgaaaaatacctttgatatcattcatactcaaggcaacgacttggtaagaaaggccagctatcgtttcgcgcaggattttgaagtgcctgcctcgttgaatatgggttctgccatcggtgatgatagtctgacggtgatggagaacgggaatattccgcagataaccagtaaatactccagcgataaccttgctattacgctacataacgccgctttcactgtcagatatgatggcagtggcaatgtcatcagaaacaaacaaatcagcgccatgaaactgacgggggtggatggaaagtcccagtacggcaatgcatttatcatcgcaaataccgttaaacattatggcggttactctgatctgggggggccgatcaccgtttataataaaacgaaaaactatattgcatcagttcaaggccacttgatgaacgcagattacactaggcgtttgattctaacaccagttgaaaataattattatgccagattgttcgagtttccattttctccaaacacaattttaaacaccgttttcacggttggtagcaataaaaccagtgattttaaaaagtgcagttatgctgttgatggtaataattctcagggcttccagatatttagttcctatcaatcatccggctggctggatattgatacaggcattaacaataccgatatcaaaattacggtgatggctggcagtaaaacccacacctttacggccagtgaccatattgcttccttgccggcaaacagttttgatgctatgccgtacacctttaagccactggaaatcgatgcttcatcgttggcctttaccaataatattgctcctctggatatcgtttttgagaccaaagccaaagacgggcgagtgctgggtaagatcaagcaaacattatcggtgaaacgggtaaattataatccggaagatattctgtttctgcgtgaaactcattcgggtgcccaatatatgcagctcggggtgtatcgtattcgtcttaataccctgctggcttctcaactggtatccagagcaaacacgggcattgatactatcctgacaatggaaacccagcggttaccggaacctccgttgggagaaggcttctttgccaactttgttctgcctaaatatgaccctgctgaacatggcgatgagcggtggtttaaaatccatattgggaatgttggcggtaacacgggaaggcagccttattacagcggaatgttatccgatacgtcggaaaccagtatgacactgtttgtcccttatgccgaagggtattacatgcatgaaggtgtcagattgggggttggataccagaaaattacctatgacaacacttgggaatctgctttcttttattttgatgagacaaaacagcaatttgtattaattaacgatgctgatcatgattcaggaatgacgcaacaggggatcgtgaaaaatatcaagaaatacaaaggatttttgaatgtttctatcgcaacgggctattccgccccgatggatttcaatagtgccagcgccctctattactgggaattgttctattacaccccgatgatgtgcttccagcgtttgctacaggaaaaacaattcgacgaagccacacaatggataaactacgtctacaatcccgccggctatatcgttaacggagaaatcgccccctggatctggaactgccggccgctggaagagaccacctcctggaatgccaatccgctggatgccatcgatccggatgccgtcgcccaaaatgacccaatgcactacaagattgccacctttatgcgcctgttggatcaacttattctgcgcggcgatatggcctatcgagaactgacccgcgatgcgttgaatgaagccaaaatgtggtatgtgcgtactttagaattgctcggtgatgagccggaggattacggtagccaacagtgggcagcaccgtccctttccggggcggcgagtcaaaccgtgcaggcggcttatcagcaggatcttacgatgctgggccgtggtggggtttccaagaatctccgtaccgctaactcgttggtgggtttgttcctgccggaatataacccggcgctcaccgattactggcaaaccctgcgtttgcgcctgtttaacctgcgccataatctttccattgacggacagccgttatcgctggcgatttacgccgagcctaccgatccgaaagcgctgctcaccagtatggtacaggcctctcagggcggtagtgcagtgctgcccggcacattgtcgttataccgcttcccggtgatgctggagcggacccgcaatctggtagcgcaattaacccagttcggcacctctctgctcagtatggcagagcatgatgatgccgatgaactcaccacgctgctactacagcagggtatggaactggcgacacagagcatccgtattcagcaacgaactgtcgatgaagtggatgctgatattgctgtattggcagagagccgccgcagtgcacaaaatcgtctggaaaaataccagcagctgtatgacgaggatatcaaccacggagaacagcgggcaatgtcactgcttgatgcagcggcaggtcagtctctggccgggcaggtgctttcaatagcggaaggggtggccgatttagtgccaaacgtgttcggtttagcttgtggcggcagtcgttggggggcagcactgcgtgcttccgcctccgtgatgtcgctttctgccacagcttcccaatattccgcagacaaaatcagccgttcggaagcctaccgccgccgccgtcaggagtgggaaattcagcgtgataatgctgacggtgaagtcaaacaaatggatgcccagttggaaagcctgaaaatccgccgcgaagcagcacagatgcaggtggaatatcaggagacccagcaggcccatactcaggctcagttagagctgttacagcgtaaattcacaaacaaagcgctttacagttggatgcgcggcaagctgagtgctatctattaccagttctttgacctgacccagtccttctgcctgatggcacaggaagcgctgcgccgcgagctgaccgacaacggtgttacctttatccggggtggggcctggaacggtacgactgcgggtttgatggcgggtgaaacgttgctgctgaatctggcagaaatggaaaaagtctggctggagcgtgatgagcgggcactggaagtgacccgtaccgtctcgttggcacagttctatcaggccttatcatcagacaactttaatctgaccgaaaaactcacgcaattcctgcgtgaagggaaaggcaacgtaggagcttccggcaatgaattaaaactcagtaaccgtcagatagaagcctcagtgcgattgtctgatttgaaaattttcagcgactaccccgaaagccttggcaatacccgtcagttgaaacaggtgagtgtcaccttgccggcgctggttgggccgtatgaagatattcgggcggtgctgaattacgggggcagcatcgtcatgccacgcggttgcagtgctattgctctctcccacggcgtgaatgacagtggtcaatttatgctggatttcaacgattcccgttatctgccgtttgaaggtatttccgtgaatgacagcggcagcctgacgttgagtttcccggatgcgactgatcggcagaaagcgctgctggagagcctgagcgatatcattctgcatatccgctataccattcgttcttaattaatgctctcgag

SEQ ID NO: 68 - protein, 5001 aa, Artificial Sequence
  Amino acid sequence of the 8836 "BCA" triple fusion protein encoded by SEQ ID NO:67
MQNSQDFSITELSLPKGGGAITGMGEALTPTGPDGMAALSLPLPISAGRGYAPAFTLNYNSGAGNSPFGLGWDCNVMTIRRRTHFGVPHYDETDTFLGPEGEVLVVADQPRDESTLQGINLGATFTVTGYRSRLESHFSRLEYWQPKTTGKTDFWLIYSPDGQVHLLGKSPQARISNPSQTTQTAQWLLEASVSSRGEQIYYQYRAEDDTGCEADEITHHLQATAQRYLHIVYYGNRTASETLPGLDGSAPSQADWLFYLVFDYGERSNNLKTPPAFSTTGSWLCRQDRFSRYEYGFEIRTRRLCRQVLMYHHLQALDSKITEHNGPTLVSRLILNYDESAIASTLVFVRRVGHEQDGNVVTLPPLELAYQDFSPRHHAHWQPMDVLANFNAIQRWQLVDLKGEGLPGLLYQDKGAWWYRSAQRLGEIGSDAVTWEKMQPLSVIPSLQSNASLVDINGDGQLDWVITGPGLRGYHSQRPDGSWTRFTPLNALPVEYTHPRAQLADLMGAGLSDLVLIGPKSVRLYANTRDGFAKGKDVVQSGDITLPVPGADPRKLVAFSDVLGSGQAHLVEVSATKVTCWPNLGRGRFGQPITLPGFSQPATEFNPAQVYLADLDGSGPTDLIYVHTNRLDIFLNKSGNGFAEPVTLRFPEGLRFDHTCQLQMADVQGLGVASLILSVPHMSPHHWRCDLTNMKPWLLNEMNNNMGVHHTLRYRSSSQFWLDEKAAALTTGQTPVCYLPFPIHTLWQTETEDEISGNKLVTTLRYARGAWDGREREFRGFGYVEQTDSHQLAQGNAPERTPPALTKNWYATGLPVIDNALSTEYWRDDQAFAGFSPRFTTWQDNKDVPLTPEDDNSRYWFNRALKGQLLRSELYGLDDSTNKHVPYTVTEFRSQVRRLQHTDSRYPVLWSSVVESRNYHYERIASDPQCSQNITLSSDRFGQPLKQLSVQYPRRQQPAINLYPDTLPDKLLANSYDDQQRQLRLTYQQSSWHHLTNNTVRVLGLPDSTRSDIFTYGAENVPAGGLNLELLSDKNSLIADDKPREYLGQQKTAYTDGQNTTPLQTPTRQALIAFTETTVFNQSTLSAFNGSIPSDKLSTTLEQAGYQQTNYLFPRTGEDKVWVAHHGYTDYGTAAQFWRPQKQSNTQLTGKITLIWDANYCVVVQTRDAAGLTTSAKYDWRFLTPVQLTDINDNQHLITLDALGRPITLRFWGTENGKMTGYSSPEKASFSPPSDVNAAIELKKPLPVAQCQVYAPESWMPVLSQKTFNRLAEQDWQKLYNARIITEDGRICTLAYRRWVQSQKAIPQLISLLNNGPRLPPHSLTLTTDRYDHDPEQQIRQQVVFSDGFGRLLQAAARHEAGMARQRNEDGSLIINVQHTENRWAVTGRTEYDNKGQPIRTYQPYFLNDWRYVSNDSARQEKEAYADTHVYDPIGREIKVITAKGWFRRTLFTPWFTVNEDENDTAAEVKKVKMPGSDNKGQTIRTRPMKNIDPKLYQKTPTVSVYDNRGLIIRNIDFHRTTANGDPDTRITRHQYDIHGHLNQSIDPRLYEAKQTNNTIKPNFLWQYDLTGNPLCTESIDAGRTVTLNDIEGRPLLTVTATGVIQTRQYETSSLPGRLLSVAEQTPEEKTSRITERLIWAGNTEAEKDHNLAGQCVRHYDTAGVTRLESLSLTGTVLSQSSQLLIDTQEANWTGDNETVWQNMLADDIYTTLSTFDATGALLTQTDAKGNIQRLAYDVAGQLNGSWLTLKGQTEQVIIKSLTYSAAGQKLREEHGNDVITEYSYEPETQRLIGIKTRRPSDTKVLQDLRYEYDPVGNVISIRNDAEATRFWHNQKVMPENTYTYDSLYQLISATGREMANIGQQSHQFPSPALPSDNNTYTNYTRTYTYDRGGNLTKIQHSSPATQNNYTTNITVSNRSNRAVLSTLTEDPAQVDALFDAGGHQNTLISGQNLNWNTRGELQQVTLVKRDKGANDDREWYRYSGDGRRMLKINEQQASNNAQTQRVTYLPNLELRLTQNSTATTEDLQVITVGEAGRAQVRVLHWESGKPEDIDNNQLRYSYDNLIGSSQLELDSEGQIISEEEYYPYGGTALWAARNQTEASYKTIRYSGKERDATGLYYYGYRYYQPWIGRWLSSDPAGTIDGLNLYRMVRNNPVTLLDPDGLMPTIAERIAALKKNKVTDSAPSPANATNVAINIRPPVAPKPSLPKASTSSQPTTHPIGAANIKPTTSGSSIVAPLSPVGNKSTSEISLPESAQSSSSSTTSTNLQKKSFTLYRADNRSFEEMQSKFPEGFKAWTPLVTKMARQFASIFIGQKDTSNLPKETVKNISTWGAKPKLKDLSNYIKYTKDKSTVWVSTAINTEAGGQSSGAPLHKIDMDLYEFAIDGQKLNPLPEGRTKNMVPSLLLDTPQIETSSIIALNHGPVNDAEISFLTTIPLKNVKPHKRPRDNKGQTIRTRPEFMYSTAVLLNKISPTRDGQTMTLADLQYLSFSELRKIFDDQLSWGEARHLYHETIEQKKNNRLLEARIFTRANPQLSGAIRLGIERDSVSRSYDEMFGARSSSFVKPGSVASMFSPAGYLTELYREAKDLHFSSSAYHLDNRRPDLADLTLSQSNMDTEISTLTLSNELLLEHITRKTGGDSDALMESLSTYRQAIDTPYHQPYETIRQVIMTHDSTLSALSRNPEVMGQAEGASLLAILANISPELYNILTEEITEKNADALFAQNFSENITPENFASQSWIAKYYGLELSEVQKYLGMLQNGYSDSTSAYVDNISTGLVVNNESKLEAYKITRVKTDDYDKNINYFDLMYEGNNQFFIRANFKVSREFGATLRKNAGPSGIVGSLSGPLIANTNFKSNYLSNISDSEYKNGVKIYAYRYTSSTSATNQGGGIFTFESYPLTIFALKLNKAIRLCLTSGLSPNELQTIVRSDNAQGIINDSVLTKVFYTLFYSHRYALSFDDAQVLNGSVINQYADDDSVSHFNRLFNTPPLKGKIFEADGNTVSIDPDEEQSTFARSALMRGLGVNSGELYQLGKLAGVLDAQNTITLSVFVISSLYRLTLLARVHQLTVNELCMLYGLSPFNGKTTASLSSGELPRLVIWLYQVTQWLTEAEITTEAIWLLCTPEFSGNISPEISNLLNNLRPSISEDMAQSHNRELQAEILAPFIAATLHLASPDMARYILLWTDNLRPGGLDIAGFMTLVLKESLNANETTQLVQFCHVMAQLSLSVQTLRLSEAELSVLVISGFAVLGAKNQPAGQHNIDTLFSLYRFHQWINGLGNPGSDTLDMLRQQTLTADRLASVMGLDISMVTQAMVSAGVNQLQCWQDINTVLQWIDVASALHTMPSVIRTLVNIRYVTALNKAESNLPSWDEWQTLAENMEAGLSTQQAQTLADYTAERLSSVLCNWFLANIQPEGVSLHSRDDLYSYFLIDNQVSSAIKTTRLAEAIAGIQLYINRALNRIEPNARADVSTRQFFTDWTVNNRYSTWGGVSRLVYYPENYIDPTQRIGQTRMMDELLENISQSKLSRDTVEDAFKTYLTRFETVADLKVVSAYHDNVNSNTGLTWFVGQTRENLPEYYWCNVDISRMQAGELAANAWKEWTKIDTAVNPYKDAIRPVILRERLHLIWVEKEEVAKNGTDPVETCDRFTLKLAFLRHDGSWSAPWSYDITTQVEAVTDKKPDTERLALAASGFQGEDTLLVFVYKTGKSYSDFGGSNKNVAGMTIYGDGSFKKMENTALSRYSQLKNTFDIIHTQGNDLVRKASYRFAQDFEVPASLNMGSAIGDDSLTVMENGNIPQITSKYSSDNLAITLHNAAFTVRYDGSGNVIRNKQISAMKLTGVDGKSQYGNAFIIANTVKHYGGYSDLGGPITVYNKTKNYIASVQGHLMNADYTRRLILTPVENNYYARLFEFPFSPNTILNTVFTVGSNKTSDFKKCSYAVDGNNSQGFQIFSSYQSSGWLDIDTGINNTDIKITVMAGSKTHTFTASDHIASLPANSFDAMPYTFKPLEIDASSLAFTNNIAPLDIVFETKAKDGRVLGKIKQTLSVKRVNYNPEDILFLRETHSGAQYMQLGVYRIRLNTLLASQLVSRANTGIDTILTMETQRLPEPPLGEGFFANFVLPKYDPAEHGDERWFKIHIGNVGGNTGRQPYYSGMLSDTSETSMTLFVPYAEGYYMHEGVRLGVGYQKITYDNTWESAFFYFDETKQQFVLINDADHDSGMTQQGIVKNIKKYKGFLNVSIATGYSAPMDFNSASALYYWELFYYTPMMCFQRLLQEKQFDEATQWINYVYNPAGYIVNGEIAPWIWNCRPLEETTSWNANPLDAIDPDAVAQNDPMHYKIATFMRLLDQLILRGDMAYRELTRDALNEAKMWYVRTLELLGDEPEDYGSQQWAAPSLSGAASQTVQAAYQQDLTMLGRGGVSKNLRTANSLVGLFLPEYNPALTDYWQTLRLRLFNLRHNLSIDGQPLSLAIYAEPTDPKALLTSMVQASQGGSAVLPGTLSLYRFPVMLERTRNLVAQLTQFGTSLLSMAEHDDADELTTLLLQQGMELATQSIRIQQRTVDEVDADIAVLAESRRSAQNRLEKYQQLYDEDINHGEQRAMSLLDAAAGQSLAGQVLSIAEGVADLVPNVFGLACGGSRWGAALRASASVMSLSATASQYSADKISRSEAYRRRRQEWEIQRDNADGEVKQMDAQLESLKIRREAAQMQVEYQETQQAHTQAQLELLQRKFTNKALYSWMRGKLSAIYYQFFDLTQSFCLMAQEALRRELTDNGVTFIRGGAWNGTTAGLMAGETLLLNLAEMEKVWLERDERALEVTRTVSLAQFYQALSSDNFNLTEKLTQFLREGKGNVGASGNELKLSNRQIEASVRLSDLKIFSDYPESLGNTRQLKQVSVTLPALVGPYEDIRAVLNYGGSIVMPRGCSAIALSHGVNDSGQFMLDFNDSRYLPFEGISVNDSGSLTLSFPDATDRQKALLESLSDIILHIRYTIRS

SEQ ID NO: 69 - protein, 13 aa, Photorhabdus luminescens
DENDTAAEVKKVM

SEQ ID NO: 70 - protein, 3 aa, Photorhabdus luminescens
PGS

SEQ ID NO: 71 - protein, 9 aa, Photorhabdus luminescens
GLIIRNIDF

SEQ ID NO: 72 - protein, 30 aa, Photorhabdus luminescens
MKNIDPKLYQKTPTVSVYDNRGLIIRNIDF

SEQ ID NO: 73 - protein, 5 aa, Photorhabdus luminescens
PGSRP

SEQ ID NO: 74 - protein, 38 aa, Photorhabdus luminescens
PRLDRAADITTQNAHDSAIVALRQNIPTPAPLSLRSRP

SEQ ID NO: 75 - protein, 47 aa, Photorhabdus luminescens
PGSEAYADTHVYDPIGREIKVITAKGWFRRTLFTPWFTVNEDENDTA

SEQ ID NO: 76 - protein, 46 aa, Photorhabdus luminescens
AEVKKVKMPRLDRAADITTQNAHDSAIVALRQNIPTPAPLSLRSRP

SEQ ID NO: 77 - protein, 20 aa, Photorhabdus luminescens
DAEISFLTTIPLKNVKPHKR

SEQ ID NO: 78 - protein, 20 aa, Photorhabdus luminescens
MQNSQDFSITELSLPKGGGA

SEQ ID NO: 79 - protein, 20 aa, Xenorhabdus nematophilus
KALLESLSDIILHIRYTIRS

SEQ ID NO: 80 - protein, 9 aa, Artificial sequence
  Chemically synthesized XptA2/TcdB2 linker peptide
PRDRTRPTS

SEQ ID NO: 81 - protein, 20 aa, Photorhabdus luminescens
WFTVNEDENDTAAEVKKVKM

SEQ ID NO: 82 - protein, 20 aa, Photorhabdus luminescens
MKNIDPKLYQKTPTVSVYDN

SEQ ID NO: 83 - protein, 9 aa, Photorhabdus luminescens
DNKGQTIRT

SEQ ID NO: 84 - protein, 36 aa, Photorhabdus luminescens
PRLDRAADITTQNAHDSAIVALRQNIPTPAPLSLRS

SEQ ID NO: 85 - protein, 52 aa, Photorhabdus luminescens
EAYADTHVYDPIGREIKVITAKGWFRRTLFTPWFTVNEDENDTAAEVKKVKM

We claim:

1. An isolated fusion protein comprising a toxin complex Class B polypeptide and a toxin complex Class C polypeptide wherein: said Class B polypeptide is a 130-180 kDa potentiator having an amino acid sequence at least 99% identical to TcdB2 as set forth in SEQ ID NO:6; and said Class C polypeptide is a 90-112 kDa potentiator having an amino acid sequence at least 99% identical to TccC3 as set forth in SEQ ID NO: 14; and said fusion protein enhances the insecticidal activity of a Class A toxin complex polypeptide XptA2$_{wi}$ as set forth in SEQ ID NO: 23.

2. The fusion protein of claim 1 wherein said fusion protein further comprises said Class A toxin complex polypeptide, said fusion protein has toxin activity, and wherein said Class A polypeptide has an amino acid sequence at least 99% identical to XptA2$_{wi}$ as set forth in SE ID NO:23.

3. The fusion protein of claim 1 wherein said Class B polypeptide and said Class C polypeptide are fused by a linker sequence.

4. The fusion protein of claim 1 wherein said Class B polypeptide and said Class C polypeptide are fused directly without a linker sequence.

5. The fusion protein of claim 1 wherein said Class B polypeptide is located at the amino terminus of said Class C polypeptide.

6. The fusion protein of claim 1 wherein said Class C polypeptide is located at the amino terminus of said Class B polypeptide.

7. The fusion protein of claim 1 wherein said fusion protein comprises SEQ ID NO:2.

8. The fusion protein of claim 2 wherein said fusion protein comprises SEQ ID NO:60.

9. The fusion protein of claim 1 wherein said Class B polypeptide is TcdB2 and said Class C polypeptide is TccC3.

10. The fusion protein of claim 2 wherein said Class B polypeptide is located at the amino terminal side of said Class C polypeptide, and said Class C polypeptide is located at the amino terminal side of said Class A polypeptide.

11. The fusion protein of claim 2 wherein said fusion protein comprises a linker sequence.

12. The fusion protein of claim 2 wherein said Class A polypeptide is fused directly to said Class B polypeptide without a linker sequence.

13. The fusion protein of claim 2 wherein said Class A polypeptide and said Class B polypeptide are fused by a linker sequence.

14. The fusion protein of claim 2 wherein said Class B polypeptide and said Class C polypeptide are fused by a linker sequence.

15. A method of controlling insects and plant pests wherein said method comprises providing, to said insect for ingestion, an effective amount of the fusion protein of claim 2, wherein said providing comprises applying said fusion protein to said plant.

16. A method of controlling insects and plant pests wherein said method comprises providing, to said insect for ingestion, effective amounts of the Class A polypeptide and the fusion protein of claim 1 wherein said providing comprises applying said fusion protein and said polypeptide to said plant.

17. The fusion protein of claim 2 wherein said Class A polypeptide is XptA2$_{wi}$.

18. The fusion protein of claim 2 wherein said Class B polypeptide is TcdB2 and said Class C polypeptide is TccC3.

19. The fusion protein of claim 2 wherein said Class A polypeptide is XptA2$_{wi}$, said Class B polypeptide is TcdB2, and said Class C polypeptide is TccC3.

20. The fusion protein of claim 2 wherein said Class A polypeptide is located at the amino terminal side of said Class B polypeptide, and said Class B polypeptide is located at the amino terminal side of said Class C polypeptide.

* * * * *

UNITED STATES PATENT AND TRADEMARK OFFICE
CERTIFICATE OF CORRECTION

PATENT NO. : 7,605,228 B2          Page 1 of 1
APPLICATION NO. : 11/070573
DATED : October 20, 2009
INVENTOR(S) : Hey et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 636 days.

Signed and Sealed this

Fifth Day of October, 2010

David J. Kappos
*Director of the United States Patent and Trademark Office*